US009770033B2

(12) United States Patent
Webb et al.

(10) Patent No.: US 9,770,033 B2
(45) Date of Patent: Sep. 26, 2017

(54) COMPOSITIONS AND METHODS FOR PEST CONTROL MANAGEMENT

(71) Applicants: Bruce Webb, Lexington, KY (US); Kendra Hitz Steele, Lexington, KY (US); Angelika Fath-Goodin, Lexington, KY (US)

(72) Inventors: Bruce Webb, Lexington, KY (US); Kendra Hitz Steele, Lexington, KY (US); Angelika Fath-Goodin, Lexington, KY (US)

(73) Assignees: University of Kentucky Research Foundation, Lexington, KY (US); Lepidext, Lexington, KY (US)

( * ) Notice: Subject to any disclaimer, the term of this patent is extended or adjusted under 35 U.S.C. 154(b) by 0 days.

(21) Appl. No.: 15/154,069

(22) Filed: May 13, 2016

(65) Prior Publication Data

US 2016/0330974 A1 Nov. 17, 2016

Related U.S. Application Data

(60) Provisional application No. 62/161,674, filed on May 14, 2015.

(51) Int. Cl.

| | |
|---|---|
| ***C12N 7/00*** | (2006.01) |
| ***C12N 15/86*** | (2006.01) |
| ***A01N 63/00*** | (2006.01) |
| ***A01N 63/02*** | (2006.01) |

(52) U.S. Cl.

CPC ............. *A01N 63/00* (2013.01); *A01N 63/02* (2013.01); *C12N 7/00* (2013.01); *C12N 2710/00021* (2013.01); *C12N 2710/00031* (2013.01); *C12N 2710/00071* (2013.01)

(58) Field of Classification Search

None

See application file for complete search history.

(56) References Cited

U.S. PATENT DOCUMENTS

| | | | |
|---|---|---|---|
| 7,261,886 | B2 | 8/2007 | Wu et al. |
| 7,476,499 | B2 | 1/2009 | Kirkegaard et al. |
| 2011/0314562 | A1 | 12/2011 | Lu et al. |

FOREIGN PATENT DOCUMENTS

| | | | |
|---|---|---|---|
| WO | WO 96/16538 | A1 | 6/1996 |
| WO | WO 2004/021781 | A2 | 3/2004 |

OTHER PUBLICATIONS

International Search Report and Written Opinion dated Oct. 31, 2016 for Application No. PCT/US2016/032345, 14 pgs.

Eberle, K.E., et al., "Microbial Control of Crop Pests using Insect Viruses," Integrated Pest Management: Principles and Practice, 2012, Cabi Publishing Wallingford, Oxon, UK, 18 pgs.

Lee, D-H, et al., "Mutations Unduced by 1,3-Butadiene Metobolics, Butadiene Diolepoxidem and 1,2,3,4-Diepoxybutane at the Hprt Locus in CHO-K1 Cells," Mol. Cells, 2002, 14(3):411-149, 9 pgs.

Webb, B., et al., "Contributed pater 225: Latency-deficient recombinant and mutant Helicoverpa zea nudiviruses that cause enhanced pathology and sterility to their insect hosts," $49_{th}$ Annual Meeting of the society for Invertabrate Pathology, Tours 2016, Jul. 28, 2016, p. 90, 1 pg.

"Adoption of Genetically Engineered Crops in the United States," United States Department of Agriculture, 1996-2015, 2015 Report, 2 pgs., accessed from: http://www.ers.usda.gov/data-products/adoption-of-genetically-engineered-crops-in-the-us/recent-trends-in-ge-adoption.aspx.

Adamo, S.A., et al., "A viral aphrodisiac in the cricket *Gryllus texenis*," J Exp Biol., 2014, 217(Pt 11):1970-1076, 7 pgs., PMID: 24625650.

Ali, M.I., et a., "Susceptibility of Bollworm and Tobacco Budworm (*Lepidoptera:* Noctuide) to Cry2Ab2 Insecticidal Protein," J Econ Entomol, 2007, 100:921-931, 11 pgs., PMID:17598557.

Ali, M.I., et al., "Susceptibility of *Helicoverpa zea* and *Heliothis virescens* (Lepidopter: Noctuidae) Populations to Cry1Ac Insecticidal Protein," J Econ Entomol, 2006, 99:164-175, 12 pgs., PMID: 16573337

Anderson, D., et al., "Rapid Generation of Recombinant Baculovirus and Expression of Foreign Genes Using BAC-To-BAC™ Baculovirus Expression Systems,"Focus , 1996, 17:53-58, 6 pgs.

Arneodo, J.D., et al., "Molecular identification of *Helicoverpa armigera* (Lepidopter: Noctuidae: Heliothinae) in Argentina and Development of a Novel PCR-RFLP Method for its Rapid Differentiation from *H. zea* and *H. gelotopoeon*," J Econ Entomol, 2015, 108(6):2505-2510, 6 pgs., PMID: 26318007.

Bedford, G.O., "Biology and Management of Palm Dynastid Beetles: Recent Advances," Annu Rev Entomol, 2013, 58:353-372, 23 pgs., PubMed PMID: 23317044.

Bergé, J.B., et al., "Emergence of minor pests becoming major pests in GE cotton in China: What are the reasons? What are the alternatives practices to this change of status?" GM Crops, 2010, 1(4): 214-219, 6 pgs., PMID: 21844676.

Bézier, A., et al., "The Genome of the Nucleopolyhedrosis-Causing Virus from *Tipula oleracea* Sheds New Light on the Nudiviridae Family," J Virol, 2015, 89(6):3008-3025, 18 pgs., PMID: 25540386.

Burand, J.P., "Pathology and Replication of the Sexually Transmitted Insect Virus HzNV-2," Advances in Virus Research, 2013, 20 pgs., ISBN: 978-1477555-04-0, iConcept Press.

Burand, J.P., et al., "Analysis of the Genome of the Sexually Transmitted Insect Virus *Helicoverpa zea* Nudivirus 2," Viruses, 2012, 4:28-61, 34 pgs, PMID:22355451.

Burand J.P., et al., "Infection with the insect virus Hz-2v alters mating behavior and pheromone production in female *Helicoverpa zea* moths," J Insect Sci,2005, 5:6, 6 pgs., PMID: 16299596.

(Continued)

*Primary Examiner* — Christopher M Babic
*Assistant Examiner* — Kimberly A Aron
(74) *Attorney, Agent, or Firm* — Frost Brown Todd LLC

(57) ABSTRACT

Disclosed are genetically modified nudiviruses capable of being sexually transmitted by an insect useful for controlling pest populations. The genetically modified nudiviruses are capable of causing sterility in a target population of insects. Also disclosed are insects infected with the disclosed genetically modified nudiviruses, methods of making the genetically modified nudiviruses, and methods of using the genetically modified nudiviruses to control an insect pest population.

7 Claims, 6 Drawing Sheets

(56) References Cited

OTHER PUBLICATIONS

Burand, J.P., et al., "In vivo dose-response of insects to Hz-2V infection," Virology Journal, 2004, 1:15, 7 pgs., PMID: 15613241.
Burand, J.P., et al., "Horizontal transmission of Hz-2V by virus infected *Helicoverpa zea* moths," J Invertebr Pathol, 2004, 85:128-131, 4 pgs., PMID:15050843.
Burand, J.P., et al., "Replication of a Gonad-Specfic Insect Virus in TN-368 Cells in Culture," J Invertebr Pathol, 1997, 70(2):88-95, 8 pgs., PMID:9281395.
Burand, J.P., et al., "Intracellular Protein Synthesis During Standard and Defective Hz-1 Virus Replication," J Gen Virol, 1986, 67:167-173, 7 pgs.
Burand, J.P., et al., "Structural and Intracellular Proteins of the Nonoccluded Baculovirus HZ-1," J Virol, Apr. 1983, 46(1):137-142, 6pgs., PMID: 16789238.
Burand, J.P., et al., "Defective Particals from a Persistent Baculovirus Infection in *Trichiplusia ni* Tissue Culture Cells," J Gen Virol, 1983, 64:391-398, 8 pgs.
Campagne, P., et al., "Dominant Inheritance of Field-Evolved Resistance to Bt Corn in *Busseola fusca*," PLoS One, 2013, 8:e69675, 7 pgs., PMID:23844262
Capinera, J.L., Corn Earnworm, *Helicoverpa* (=Heliothis) *sea* (Boddie) (Lepidoptera:Noctuidae), IFAS Extension, University of Florida, 2000, revised Aug. 2007, 6 pgs., accessed from: http://edis.ifas.ufl.edu/in302.
Carriere, Y., et al., "Evolutionary ecology of insect adaptation to Bt crops," Evol Appl, 2010, 3:561-573, 13 pgs.
Choa, Y.C., et al., "A 2.9-Kilobase Noncoding Nuclear RNA Functions in the Establishment of Persistent Hz-l Viral Infection," J Virol, 1998, 72(3):2233-2245, 13 pgs., PMID: 9499081.
Chao, Y.C., et al., "Differential Expression of Hz-1 Baculovirus Genes during Productive and Persistent Viral Infections," J Virol., Marc. 1992, 66(3):1442-1448, 7 pgs., PMID: 1738201.
Chen, H.H., et al., "Negative regulatory regions of the PAT1 promoter of Hz-1 virus contain GATA elements which associate with cellular factors and regulate promoters activity," J Gen Virol, 2001, 82:313-320, 8 pgs, PMID: 11161268.
Cheng, C.H., et al., "Analysis of the Complete Genome Sequence of the Hz-1 Virus Suggests that it is Related to Members of the *Baculoviridae*," J Virol, Sep. 2002, 76(18):9024-9034, 11 pgs, PMID: 12186886.
Cheng, R.L., et al., "Browm Planthopper Nudivirus DNA Integrated in its Host Genome," J Virol, May 2014, 88(10):5318, 9 pgs., PMID: 24574410.
Cunningham, J.P., et al., "Understanding Heliothine (Lepidopter: Heliothinae) Pests: What is a Host Plant?" J Econ Entomol., 2014, 107(3):991-896, 16 pgs., PMID: 25026644.
De Miranda, J.R., et al., "Venereal and vertical transmission of deformed wing virus in honeybees (*Apis mellifera* L.)," J Invertebr Pathol, 2009, 98(2):184-189, 6 pgs., PubMed PMID: 18358488.
"The Enviromental Protection Agency's White Paper on *Bacillus thuringienis* Plant-pesticide Resistance Mangement," United States Environmental Protection Agency ; Prevention, Pesticides and Toxic Substances, 7511W, EPA 739-S98-001, May 1998, 90 pgs.
Ferrelli, M.L., et al., "Characterization of a new *Helicoverpa armigera* nucleopolyhedrovirus variant causing epizootic on a previously unreported host, *Helicoverpa gelotopeon* (Lepidoptera: Noctuidae)," J Invertebr Pathol., 2015, pii: S0022-2011(15)30008-2, 15 pgs., PMID: 26296927.
Fitt, G.P., "The Ecology of *Heliothis* Species in Relation to Agrosystems.," Ann Rev Entomol, 1989, 34:17-52, 38 pgs.
Franz, G., et al., "Molecular technologies to improve the effectiveness of the sterile insect technique," Genetica, 2011, 139(1):1-5, 6 pgs., PMID: 212589957.
Gherezghiher, T.B., et al., "1,2,3,4-Diepoxybutane-Induced DNA-Protein Cross-Linking in Human Fibrosarcoma (HT1080) Cells," J Proteome Res., May 2013, 12(5):2151-2164, 27 pgs., PMID: 23506368.
Granados, R.R., et al., "An insect cell line persistently infected with a baculovirus-like particle," Intervirol, 1978, 10(5):309-17, 9 pgs.
Hamm, J.J., "Gonad-Specific Virus of *Helicoverpa zea* Does not Affect Infectivity of Nuclear Poluhedrosis Virus," J. Entomol. Sci., 1997, 32(1):106-109, 4 pgs.
Hamm, J.J., et al., "Oviposition Day Effect on Incidence of Agonadal Progeny of *Helicoverpa zea*(Lepidoptera: Nocutidae) Infected With a Virus," Ann. Entomol. Soc. Am., 1996, 89(2):266-275, 10 pgs.
"*Helicoverpa zea* (American cotton bollworm)," Datasheet, May 28, 2015, accessed May 19, 2016, from CABI http://www.cabi.org/isc/datasheet/26776, 30 pgs.
"*Helicoverpa armigera* TWG Report," Rev. 1, USDA APHIS PPQ Technical Working Group, Dec. 2014, 20 pgs.
"Statistics and facts on genetically modified crops," Statista, The Statistics Portal, Jul. 2104, accessed Jul. 10, 2015 from http://www.statista.com/topics/2062/genetically-modified-crops/, 4 pgs.
Huang, F., et al., "Success of the high dose/refuge resistance management strategy after 15 years of Bt crop use in North America," Entomol Exp Appl, 2011, 140:1-16, 17 pgs.
James, C., "Global status of Commercialized Biotech/GM Crops: 2012," Internatinal Service for the Acquistion of Agri-Biotech Applications (ISAAA), Brief 44, 2012 (Ithaca, NY: ISAAA), 329 pgs.
Kempf, C., et al., "Semliki Forest Virus Induced Cell-Cell Fusion at Neutral Extracellular pH," Biosci Rep., 1990, 10(4):363-374, 12 pgs., PMID: 2249002.
Kimble, M., et al., "The beta3-Tubulin Gene of *Drosophila melanogaster* is Essential for Viability and Fertility," Genetics, Dec. 1990, 126(4):991-1005, 15 pgs.
Kirkpatrick, B.A., et al., "Primary Infection of Insect Tracheae by *Autogtapha californica* M Nuclear Polyhedrosis Virus," Virology, 1994, 2013:184-186, 3 pgs.
Knell, R.J., et al., "Sexually transmitted diseases of insects: distribution, evolution, ecology and host behavior," Biol Rev Camb Philos Soc, 2004, 79(3):557-581, 25 pgs., PMID: 15366763.
Lee, S., et al., "First Report of *Oryctes rhinoceros nudivirus* (Coleoptera: Scarabaeidae) Causing Severe Disease in *Allyrima dichotoma* in Korea," J Insect Sci, 2015, 12:15, 3 pgs., PubMed PMID: 25765317.
Lee, J.C., et al., "Superinfection-Induced Apoptosis and its Correlation with the Reduction of Viral Progeny in Cells Persstently Infected with Hz-1 Baculovirus," J Virol., Dec. 1993, 67(12):6989-94, 6 pgs., PMID: 8230422.
Lin, C.L., et al., "Persistent Hz-1 Virus Infection in Insect Cells: Evidence for Insertion of Ciral DNA into Host Chromosomes and Viral Infection in a Latent Status," J Virol., Jan. 1999, 73(1):128-39, 12 pgs., PMID: 9847315.
Lui, X., et al., "Synergistic effects of Cydia pomonella granulovirus GP37 on the infectivity of nucleopolyhedroviruses and the letality of *Bacillus thuringiensis*," Arch Virol, 2011, 156:1707-1715, 9 pgs.
Lupiani, B., et al., "Development and Use of PCR Assay for Detection of the reproductive Virus in Wild Populations of *Helicoverpa zea* (Lepidoptera: noctuidae)," J Invertebr Pathol, 1999, 73:107-112, 6 pgs.
Luttrell, R.G., et al., "*Helicoverpa zea* and Bt cotton in the United States," GM Crops & Food: Biotechnol in Agriculture Food Chain, 2012, 3(3):213-227, 15 pgs.
Martinez, A.M., et al., "Effects of optical brighteners used in biopesticide formulations on crops: reflectance, stomatal conductance, photosynthesis, and growth," Commum Argic Appl Biol Sci, 2009, 74(1):117-123, 8 pg.
Morrison, N.I., et al., "Engineered Repressible Leethality for Controlling the Pink Bollworm, a Lepidopteran Pest of Cotton," PLoS One, Dec. 2012, 7(12):e50922, 10 pgs., PMID: 23226548.
Nguyen, Q., et al., "Genome scale analysis of differential mRNA expression of *Helicoverpa zea* insect cells infected with a *H. armigera* baculovirus," Virology 444(1-2):158-170, 13 pgs., PMID: 23827436.
Nguyen, Q., et al., "Transcriptome Sequencing of and Microarray Development for a *Helicoverpa zea* Cell Line to Investigate In Vitro Insect Cell-Baculovirus Interactions," PloS One, May 2012, 7(5):e36324, 15 pgs., PMID: 22629315.

(56) References Cited

OTHER PUBLICATIONS

Olsen, O-A., et al., "The mutagenic effects of diepoxybutane in wild-type and mutagen-sensitive mutants of *Drosophila melanogaster*," Mutant Res, 1982, 92(1-2):107-115, 9 pgs.
Pichon, A., et al., "Recurrent DNA virus domestication leading to different parasite virulence strategies,"Sci Adv, 2015, 1(10):e1501150, 9 pgs., PMID: 26702449.
Pushparajan, C., et al., "Characterization of growth and *Oryctes rhinoceros* nudivirus production in attached cultures of the DSIR-HA-1179 coleopteran insect cell line," Cytotechnology, 2013, 65(6):1003-1016, 14 pgs., PMID: 23979321.
Raina, A.K., et al., "Gonad-specific virus of corn earworm," Nature, Apr. 27, 1995, 374:770, 1 pg.
Raina, A.K., et al., "Further Characterization of the Gonad-Specific Virus of Corn Earworm, *Helicoverpa zea*," J Invertebr Pathol, 2000, 76:6-12, 7 pgs., PMID: 10963397.
Raina, A.K., et al., "Aquistion, persistence, and species susceptibility of the Hz-2V virus," J Invertebr Pathol, 2006 93:71-74, 4 pgs.
Rallis, C.P., et al., "Pathology and ultrastructure of Hz-2V infection in the agonadal female corn earworm, *Helicoverpa zea*," J Invertebr Pathol, 2000, 81:33-44, 12 pgs., PMID: 12417211.
Rallis, C.P., et al., "Pathology and Ultrastructure of the insect virus, Hz-2V, infecting agondal male corn earworms, *Helicoverpa zea*," J Invertbr Pathol, 2002, 80:81-89, 9 pgs., PMID: 12383433.
Reardon, J.T., et al., "Molecular Analysis of Diepoxybutane-Induced Mutations at the rosy Locus of *Drosophila melanogaster*," Genetics, 1987, 115:323-331, 9 pgs., PMID: 17246369.
Simmons, G.S., et al., "Field Performance of a Genetically Engineered Strain of Pink Bollworm,"PLoS One, Sep. 2011, 6(9):e24110, 11 pgs., PMID: 21931649.
Shalsky, R.L., et al., "Viruses, microRNAs, and Host Interactions," Annu Rev Microbiol, 2010, 64:123-41, 23 pgs., PMID: 20477536.
Smith-Pardo, A., "The Old World Bollworm *Helicoverpa armigera* (Hübner) (Lepidopter: Noctuidae: Heliothinae) Its Biology, Economic Importance and its Recent introduction into the Western Hemisphere," Boletin del musco entomológico, 2014, 6(1):18-28, 11 pgs.
Tabashnik, B.E., et al., "Defining Terms for Proactive Management of Resistance to Bt Crops and Pesticides," J Econ Entomol, 2014, 107(2):496-507, 12 pgs., PMID: 24772527.
Tabashnik, B.E., et al., "Insect resistance to Bt crops: lessons from the first billion acres," Nat Biotechnol, 2013, 31:510-521, 12 pgs. PMID:23752438.
Tabashnik, B.E., et al., "Field-Evolved Insect Resistance to Bt crops: Definition Theory, and Data," J Econ Entomol, 2009, 102(6):2011-2025, 15 pgs.
Tretyakova, N.Y., et al., "DNA-Reactive Protein Monoepoxides Induced Cell Death and Mutagenesis in Mammalian Cells," Biochemistry, May 2013, 52(18):3171-3181, 22 pgs., PMID: 23566219.
Tyagi, A., et al., "Bioinformatics analysis of codon usage patterns and influencing factors in *Penaeus monodon* nudivirus," Arch Virol, 2016, 161(2):459-464, 6 pgs., PMID: 26586333.
Unckless, R.L., "A DNA Virus of *Drosophila*," PLoS One, 2011, 6(10):e26564, 10 pgs., PMID: 22053195.
United States Department Agriculture (USDA), "Acreage," Jun. 30, 2015, ISSN: 1949-1522, 42 pgs., accessed from www.usda.gov/nass/PUBS/TODAYRPT/acrg0615.pdf.
Walters, M., et al., "Field Longevity of a Fluorescent Protein Marker in an Engineered Strain of the Pink Bollworm, *Pectinophora gossypiella* (Saunders)," PLoS One, 2012, 7(6):e38547, 7 pgs., PMID: 22693645.
Wang, Y., et al., "The genome of *Oryctes rhinoceros* nudivirus provides novel insight into the evolution of nuclear arthropod-specific large circular double-stranded DNA viruses," Virus Genes, 2011, 42(3):444-456, 14 pgs. PMID: 21380757.
Wang, Y., et al., "Nudiviruses and other large, double-stranded circular DNA viruses of invertebrates: New insights on an old topic," J Invertebr Pathol, 2009, 101(3):187-193, 7 pgs. PMID: 19460388.
Wang, Y., et al., "Sequencing of the large dsDNA genome of *Oryctes rhinoceros* nudivirus using multiple displacement amplification of nanogram amounts of virus DNA," J Virol Methods, 2008, 152(1-2):106-108, 3 pgs., PMID: 18598718.
Wang, Y., "The Genome of *Gryllus bimaculatus* nudivirus Indicates an Ancient Diversification of Baculovirus-Related Noncluded Nudiviruses of Insects," J Virol, 2007, 81(10):5395-5406, 12 pgs., PMID:17360757.
Wang, Y., et al., "Genomic analysis of *Oryctes rhinoceros* virus reveals genetic relatedness to *Heliothis zea* virus 1," Arch Virol, 2007, 152(3):519-531, 14 pgs., PMID: 17106621.
Wijen, J.P., et al., "Genetic damage by bifunctional agents in repair-active pre-meiotic stages of Drosophila males," Mutat Res, 2001, 478:107-117, 11 pgs., PMID: 11406175.
Wood, H.A., et al., "Persistant and productive infections with the Hz-1 baculovirus," Current topics in microbiology and immunology, 1986, 131:119-133, PMID:: 3816297, 1 pg.
Wu, Y.L., et al., "The Early Gene hhil Reactives *Heliothis zea* Nudivirus 1 in Latently Infected Cells," Journal of Virology, Jan. 2010, 84(2):1057-1065, 9 pgs., PMID: 19889784.
Wu, Y.L., et al., "A Non-coding RNA of insect HzNV-1 Virus Establishes Latent Viral Infection through MicroRNA," Scientific Reports, 2011, 1:60, 10 pgs., PMID: 22355579.
Wu, Y.L., et al., "*Heliothis zea* Nudivirus 1 Gene hhil Induces Apoptosis Which is Blocked by the Hz-iap2 Gene and a Noncoding Gene, pagl," Journal of Virology, 2011, 85:6856-6866, 11 pgs., PMID: 21543471.
Wu, Y.L., et al., "Cooperation of iel and p35 genes in the activation of baculovirus AcMNPV and HzNV-1 promoters," Virus Res, 2008, 135(2):247-254, 8 pgs., PMID: 18486255.
Yang, Y.T., et al., "The genome and occlusion bodies of marine Penaeus monodon nudivirus(PmNV, also known as MBV and PemoNPV) suggest that it should be assigned to a new nudivirus genus that is distinct from the terrestrial nudivirus," BMC Genomics, 2014, 15:628, 24 pgs., PMID: 25063321.
Yazaki, K., et al., "A new method for extracting circular and supercoiled genome segments from cytoplasmic polyhedrosis virus," J Virol Methods, 1986, 14(3-4):275-283, 9 pgs., PMID: 3539959.
Zhao, X.-C., et al., "Hybridization between *Helicoverpa armigera* and *Helicoverpa assulta* (Lepidoptera: Noctuidae): development and morphological characterization of $F_1$ hybrids," Bulletin of Entomol Research, 2005, 95:409-416, 8 pgs.
Swenson, SJ, et al., "Corn Earworms (*Lepidoptera: Noctuidae*) as Pest of Soybean," J. Interg. Pest Mngmt., 2013: 4(2):1-8, 8 pgs.

COMPOSITIONS AND METHODS FOR PEST CONTROL MANAGEMENT

CROSS-REFERENCE TO RELATED APPLICATIONS

This application claims the benefit of and priority to U.S. Provisional Application Ser. No. 62/161,674, filed on May 14, 2015, entitled "Mutant Nudivirus and Method for Using Same for Insect Control," the contents of which are incorporated herein in their entirety for all purposes.

STATEMENT REGARDING FEDERALLY SPONSORED RESEARCH

This invention was made with government support under 1338775 by the National Science Foundation. The government has certain rights in the invention.

BACKGROUND

Insect pests cause crop damage worldwide resulting in significant losses to food and fiber crops and increased production costs that target control of such pests. For example, the Heliothine complex of lepidopteran moths cause in excess of 2 B dollars in damage and cost of control in the United States annually. While all crops are susceptible to similar pest pressure, transgenic expression of *Bacillus thuringiensis* (Bt) toxins was developed to control the lepidopteran pests and has become a major tool for control of these and other insect pests. Since the commercial introduction of Bt crops in 1996, they have been adopted around the world and have been grown on more than one billion acres worldwide. In the US, 81% of corn and 84% of cotton express one or more Bt toxins. (http://www.ers.usda.gov/data-products/adoption-of-genetically-engineered -crops-in-the-us/recent-trends-in-ge-adoption.aspx, 2015 report.) Unfortunately, due to the remarkable ability of insects to adapt to insecticides, resistance to Bt toxins was predicted and reports of field-evolved resistance and reduced efficacy are increasing. Such resistance is a threat to the sustainability of important Bt crops, in the US and elsewhere. Thus, there is a continuing need to develop new methods to control insect pests. For example, *Helicoverpa zea* (*H. zea*, commonly known as the corn earworm), is a major polyphagous moth pest in the Heliothine complex in the United States and causes millions of dollars of damage to corn and cotton plants each year.

A number of pests in the Heliothine complex of moths, notably *H. zea H. armigera* and *Heliothis virescens* are highly polyphagous and cause economically significant damage to many crops. Crops commonly damaged by *H. zea* include cotton, corn, soybean, sunflowers, tomato, sorghum, strawberry, peppers, beans, aubergine, okra, peas, millet, cucumber, melon, lettuce, cauliflower, and cabbage. Because *H. zea* attacks a wide variety of plants and, in many instances, is developing resistance to Bt crops, farmers rely heavily on pesticides to control this pest insect.

The need for pest management, such as in field, fruit and vegetable crops, is a need in the art, which will only become more critical as resistance to Bt expands. Further, there is a need for pest management that does not involve the use of conventional pesticides or transgenic technologies such as in organic cropping systems. The instant invention addresses one or more aforementioned needs in the art.

BRIEF SUMMARY

Disclosed are genetically modified nudiviruses capable of being sexually transmitted by an insect useful for controlling pest populations. The genetically modified nudiviruses are capable of causing sterility in a target population of insects. Also disclosed are insects infected with the disclosed genetically modified nudiviruses, methods of making the genetically modified nudiviruses, and methods of using the genetically modified nudiviruses to control an insect pest population.

DETAILED DESCRIPTION

Figure 1:
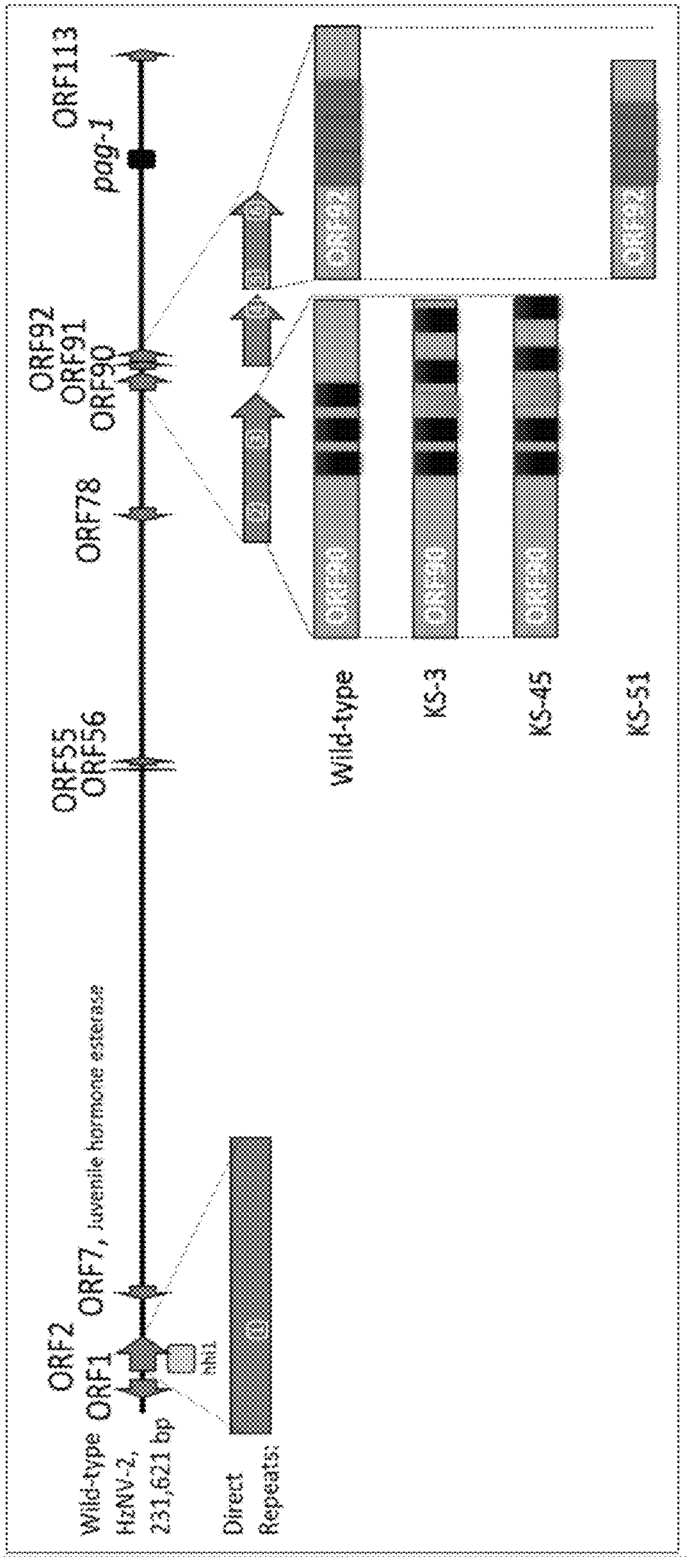
FIG. 1. Schematic of nudivirus genome showing genes known to be involved or implicated in sterilizing mutations.

As used herein and in the appended claims, the singular forms "a," "and," and "the" include plural referents unless the context clearly dictates otherwise. Thus, for example, reference to "a method" includes a plurality of such methods and reference to "a dose" includes reference to one or more doses and equivalents thereof known to those skilled in the art, and so forth.

The term "about" or "approximately" means within an acceptable error range for the particular value as determined by one of ordinary skill in the art, which will depend in part on how the value is measured or determined, e.g., the limitations of the measurement system. For example, "about" can mean within 1 or more than 1 standard deviations, per the practice in the art. Alternatively, "about" can mean a range of up to 20%, or up to 10%, or up to 5%, or up to 1% of a given value. Alternatively, particularly with respect to biological systems or processes, the term can mean within an order of magnitude, preferably within 5-fold, and more preferably within 2-fold, of a value. Where particular values are described in the application and claims, unless otherwise stated the term "about" meaning within an acceptable error range for the particular value should be assumed.

The term "closely related" as used herein, with respect to the term insect and/or moth, means a species so closely related so as to support replication of the HzNV-2 virus.

The terms "express" and "expression" mean allowing or causing the information in a gene or DNA sequence to become manifest, for example producing a protein by activating the cellular functions involved in transcription and translation of a corresponding gene or DNA sequence. A DNA sequence is expressed in or by a cell to form an "expression product" such as a protein. The expression product itself, e.g. the resulting protein, may also be said to be "expressed". An expression product can be characterized as intracellular, extracellular or secreted. The term "intracellular" means something that is inside a cell. The term "extracellular" means something that is outside a cell. A substance is "secreted" by a cell if it appears in significant measure outside the cell, from somewhere on or inside the cell.

The term "gene", also called a "structural gene" means a DNA sequence that codes for or corresponds to a particular sequence of amino acids which comprise all or part of one or more proteins or enzymes, and may or may not include introns and regulatory DNA sequences, such as promoter sequences, 5'-untranslated region, or 3'-untranslated region which affect for example the conditions under which the gene is expressed. Some genes, which are not structural genes, may be transcribed from DNA to RNA, but are not translated into an amino acid sequence. Other genes may function as regulators of structural genes or as regulators of DNA transcription.

By "genetically modified" is meant a gene that is altered from its native state. The term "genetically modified," as used herein, includes a sequence (a virus, for example) that contains genetic material from more than one organism. The term further includes a sequence that is modified from its native state, for example, via a deletion or insertion, and which does not include genetic material from more than one organism. The latter may be referred to as a "mutant" as used herein.

The instant disclosure addresses one or more needs in the art as described above. In one aspect, the present disclosure addresses the globally important need for new methods to control insect pests in crops threatened by such pests. In a further aspect, the disclosure addresses an increasingly important issue, Bt resistance, that threatens the sustainability of insect-resistant transgenic crops.

A sexually transmitted insect virus, *Helicoverpa zea* nudivirus 2 (HzNV-2, accession number NC_004156.), is known to cause approximately 33% of infected *H. zea* to be sterile. (Raina 1995). Wildtype (WT) HzNV-2, however, is not a potential biological control agent due to the high proportion of asymptomatic carrier moths. Applicant has found that HzNV-2 can be modified so that extremely high percentages, for example, up to 100%, or greater than about 90%, of the infected *H. zea* become sterile. As such, the mutant HzNV-2 may be an important tool in controlling various insect pests by causing collapse in the target insect population. In turn, this modified virus can be used to infect a target insect, and control an insect population without the use of traditional pesticides, or, alternatively, can be used in combination with traditional pesticides such that the amount of the pesticide used is minimized. Such a technology may have particular utility in control of populations of Bt resistant insects and invasive insect populations for which traditional pesticides are ineffective. Applicant's approach allows for pest control via release of insects infected with a sexually transmitted virus that can be transmitted by mating in the targeted farming area. The approach developed by Applicant is effective for both transgenic and/or non-transgenic crops and is capable of targeting pest species in which the virus replicates and is sexually transmitted.

Attempts to control insect populations via genetic manipulation of crops is currently limited due to the ability of insects to rapidly develop resistance to the genetically added toxins, and is further limited by the costs to producers to use such modified crops. For example, crops expressing the *Bacillus thuringiensis* (Bt) toxins were introduced twenty years ago to control caterpillar pests. Since then, they have been adopted worldwide, planted on more than one billion acres and have become one of the most successful and rapidly adopted agricultural technologies since the 'green revolution' of the mid-20th century (James, 2012). As of 2015 in the US, 81% of corn and 84% of cotton express one or more Bt toxins. However, the widespread adoption of Bt technology carries the significant risk that overuse will inevitably lead to development of insect resistance to Bt toxins and crop failures, which threatens the technology's continued viability (Carriere et al., 2010, Tabashnik et al., 2013; Tabashnik et al., 2009). This risk, which always has been recognized by regulators, industry, and researchers, has been managed by resistance monitoring and the use of refuge strategies to delay resistance. These refuge strategies, which have been mandated by the EPA in the USA with similar mandates in other countries, entail the planting of nearby non-transgenic plants to maintain susceptible insect populations (EPA, 1998; Huang et al., 2011). Unfortunately, this practice is not always followed due to cost to producers, and is not always effective because of the remarkable ability of insects to evolve resistance to insecticides. Increasing insect resistance to Bt plants is reported, and some insects exhibit resistance traits that are genetically dominant (Campagne et al., 2013). To summarize, Bt-resistant insects represent an ongoing and increasingly important threat to the continued efficacy of Bt crops, and to food and fiber production in the US and worldwide.

One insect pest threatening Bt crops is the corn earworm, *Helicoverpa zea*, a lepidopteran moth. *H. zea* is found throughout North America, for example, where it is the second most costly crop pest (Fitt, 1989), and is also found in Central America, the Caribbean, and South America. *H. zea*, which feeds on many different plants and has several common names (e.g., corn earworm, cotton budworm, tomato fruitworm) has some strains that are 1000-times more resistant to Bt toxin than susceptible insects (Ali and Luttrell, 2007; Ali et al., 2006).

Applicant has developed a new approach to suppress insect pest populations. In a further aspect, Applicant has developed a new approach to managing Bt resistance, which relies upon engineering or mutating a sexually-transmitted insect virus that sterilizes infected insects (including complete or partial sterility). Insects containing the mutant virus may be released in areas where Bt resistance is present in *H. zea* populations, thereby suppressing these targeted populations and preserving the utility of the Bt transgenic plants and/or non-transgenic plants. Similarly, the susceptible pest insects are commonly invasive across the world and the disclosed methods may be used to reduce and eliminate the invasive insect pest populations. The viruses developed by Applicant are mutant and recombinant forms of a naturally-occurring (i.e., wild-type) virus, *Helicoverpa zea* nudivirus 2 (HzNV-2), which infects *H. zea*. HzNV-2 is the only lepidopteran insect virus which has been shown to be sexually transmitted and causes sterility in both males and females. In one aspect, the infected insect may have partial sterility, defined as when a female *H. zea* moth lays less than 30 viable eggs each day due to damage to her reproductive organs. In one aspect, the infected insect may have complete sterility, defined as the inability of a female moth to lay viable eggs due to damage to her reproductive organs.

In one aspect, disclosed is a genetically modified nudivirus of a wild type nudivirus. The genetically modified nudivirus contemplated herein is generally capable of being sexually transmitted by an insect and capable of causing sterility in an insect at a rate of greater than about 50%, or from about 50% to about 100%, or from about 80% to about 95% or from about 90% to about 100% following infection of said insect with said nudivirus comprising a genetic mutation.

In one aspect, the wild type nudivirus has at least about 80% sequence identity to *Helicoverpa zea* nudivirus 2 (HzNV-2) virus. The wild type nudivirus may be characterized in that it has a latent phase, has about 80% or greater sequence identity to *Helicoverpa zea* nudivirus 2 (HzNV-2, also known as *Heliothis zea* nudivirus or gonad specific virus) virus, and is capable of replicating in one or more moths.

In one aspect, the genetically modified nudivirus may contain a disruption in a latent phase of said wild type nudivirus.

In one aspect, the insect may be a lepidopteran moth in the family noctuidae which supports replication of the HzNV-2 virus in reproductive tissues sufficient to cause sterility at a rate of 50% or greater. The insect may be selected from *Helicoverpa zea* (*H. zea*) *H. armigera, H. assulta, Heliothis virescens, Agrotis ipsilon, Spodoptera frugiperda, Spodoptera exiguae*, closely related moths, noctuid moths, or combinations thereof.

In one aspect, genetic modification may be a mutation in one or more genes selected from the persistence-associated gene (pag1) (which encodes PAT1, or the persistence associated transcript (SEQ ID NO: 7), ORF 90 (SEQ ID NO: 4), ORF92 (SEQ ID NO: 5), ORF 2 (SEQ ID NO: 3), or combinations thereof, such that the modification is sufficient to disrupt expression of one or more of such genes, for example, wherein said disruption reduces expression or is a functional knockout. In one aspect, the genetic modification may be a mutation in the persistence associated gene (pag1) sufficient to disrupt expression of the pag1 gene. In one aspect, the genetic modification may be a mutation in the PAT1 gene (SEQ ID NO: 7), which is the persistently-associated transcript and has been shown to be involved in the establishment of latent infections of HzNV-1. In one aspect, the genetic modification may be a mutation in one or more sequences selected from dr1 (atgaagctgaggatgaatctgaac, SEQ ID NO: 14), dr2 (gaaactcctaaatcaaaggatgaacctaaagcaaag, SEQ ID NO: 15), dr3 (atgaaaaagcaaaggctgaggcgaaggctaaagccgatgctgctgcaaaagccaaagctg, SEQ ID NO: 16), dr4 (ttataccagagagcaagccagaaa, SEQ ID NO: 17), dr5 (acctaaagttgaatctaaagtagt ggaaccacctaaagcggaatctaa aacagtggaagctcctactaaaacagttgaagt, SEQ ID NO: 18), dr6 (agctgccgctaaacgcaaagccgaggctga, SEQ ID NO: 19), or a combination thereof. In one aspect, the genetic modification may be a mutation in dr3 (SEQ ID NO: 16), for example, KS-3 in which there is a by insertion at 175,550 and KS-45, 80 bp insertion at 175,650. In one aspect, the genetic modification may be a mutation in dr6 (SEQ ID NO: 19), for example, KS-51, having a 29 bp deletion at 180,270-180,299.

In a further aspect, the genetic modification is one in which an increase in activity of a viral regulatory gene results from the modification, wherein said viral regulatory gene is hhi-1 (SEQ ID NO: 8). In certain aspects, the identification of a genetic modification of interest can be determined via detection of increased hhi-1 activity.

In one aspect, the genetically modified nudivirus, may be obtained via chemical mutagenesis. In another aspect, the genetically modified nudivirus may be obtained via recombinant DNA technology. Exemplary, non-limiting methods are disclosed herein. In a further aspect, the genetically modified nudivirus may be obtained using gene editing technology as is known in the art.

In one aspect, a method of reducing a population of lepidopteran moths is disclosed. The method may comprise the step of introducing an insect infected with a genetically modified nudivirus as disclosed herein into the population of interest. In one aspect, infected insects of a single sex may be introduced into a target population, for example an all-male or all-female population of insects. In another aspect, a mixed population of infected insects may be introduced.

In one aspect, an insect infected with a virus as described above is disclosed. The insect may be a lepidopteran moth. In further aspects, the insect may be *Helicoverpa zea* (*H. zea*) *H. armigera, H. assulta, Heliothis virescens, Agrotis ipsilon, Spodoptera frugiperda, Spodoptera exiguae* or a closely-related moth, for example, a closely related moth, or noctuid moths. The insect may be a female or a male.

In one aspect, a method of making an insect capable of transmitting a genetically modified nudivirus as disclosed herein to a population of insects is disclosed. The method may comprise the step of infecting an insect with a genetically modified nudivirus as described herein. In one aspect, the insect is a lepidopteran moth. The insect may be *Helicoverpa zea* (*H. zea*) *H. armigera, H. assulta, Heliothis virescens, Agrotis Ipsilon, Spodoptera frugiperda, Spodoptera exiguae* or a closely related moth or noctuid moth. The method may utilize male insects, female insects, or both. In one aspect, the genetically modified nudivirus may be derived from a viral plug. The genetically modified nudivirus may be administered orally to the insect. In other aspects, the genetically modified nudivirus may be administered to an insect via direct inoculation of insect larvae or adult moths by puncturing the cuticle of the insect with a pin containing viral inoculum derived from a viral plug. In a further aspect, the genetically modified nudivirus may be administered to the insect via direct hypodermic injection into third instar larvae or moths.

In one aspect, a method of protecting a crop susceptible to a moth pest from moth pest damage is disclosed. In this aspect, the method may comprise the step of introducing insects infected with a genetically modified nudivirus as described herein, into a crop of interest. The crop may be any crop threatened by the pest, and may include, for example, the following non-limiting list of crops: corn, cotton, soybeans, tomatoes, sorghum, artichoke, asparagus, cabbage, cantaloupe, collard, cowpea, cucumber, eggplant, lettuce, lima bean, melon, okra, pea, pepper, potato, pumpkin, snap bean, spinach, squash, sweet potato, and watermelon, alfalfa, clover, cotton, flax, oat, millet, rice, sorghum, soybean, sugarcane, sunflower, tobacco, vetch, and wheat, avocado, grape, peaches, pear, plum, raspberry, strawberry, carnation, geranium, gladiolus, nasturtium, rose, snapdragon, zinnia, and combinations thereof (see http://edis.ifas.ufl.edu/in302). In certain aspects, the crop may be a *Bacillus thuringiensis* (Bt) toxin producing crop. The insect used may be any insect as described above.

In a further aspect, a method of sterilizing an insect population is disclosed. The method may include the step of introducing a genetically modified nudivirus as described herein into a target insect population. This may include an invasive insect population, and may further include an insect population that is Bt resistant. One such example insect is the lepidopteran moth, which may further include *Helicoverpa zea* (*H. zea*), *H. armigera, H. assulta, Heliothis virescens, Agrotis ipsilon, Spodoptera frugiperda, Spodoptera exiguae* and closely related moths or noctuid moths.

In one aspect, a method of making a genetically modified nudivirus via chemical modification is disclosed. The method may comprise the steps of a) incubating a population of insect cells infected with a virus with about 0.05 mM to about 0.1 mM 1,3-butadiene diepoxide (or 1,2,3,4-Diepoxybutane or "DEB") for at least 1 hour and up to to five hours at a temperature range of about 26 to about 28° C., wherein the population of infected insect cells may comprise an Sf9 insect cell, for example, further wherein the insect cell may be infected with a virus having at least 80% identity, or at least 85% identity, or at least 90% identity, or at least 95% identity, or at least 99% identity to a wild-type HzNV-2 virus (SEQ ID NO: 1), and wherein the incubation is sufficient to induce one or more mutations in the HzNv-2 virus;

b) purifying the virus, wherein the purifying step includes the steps of i. culturing the population of insect cells infected with a virus in a DEB-free media, wherein the population of infected insect cells are isolated and washed prior to the culturing step;

ii. collecting a supernatant from DEB-free media to obtain a DEB-exposed virus population;

c) amplifying and collecting the mutated virus from the DEB-exposed virus population, wherein the collection step may comprise selecting virus from a plaque having a large plaque phenotype.

Exemplary methods making a genetically modified nudivirus via chemical modification are provided below.

EXAMPLES

The present invention may be understood more readily by reference to the following detailed description of preferred embodiments of the invention and the Examples included therein and to the Figures and their previous and following description. Although any methods and materials similar or equivalent to those described herein can be used in the practice or testing of the present invention, the preferred methods, devices, and materials are now described. All references, publications, patents, patent applications, and commercial materials mentioned herein are incorporated herein by reference for the purpose of describing and disclosing the materials and/or methodologies which are reported in the publications which might be used in connection with the invention. Nothing herein is to be construed as an admission that the invention is not entitled to antedate such disclosure by virtue of prior invention.

Method—Generating a Recombinant HzNV-2 Virus

To generate a yfp insert mutant virus using recombinant DNA technology, Applicant replaced the pag1 gene with a gene encoding yellow fluorescent protein (yfp) by homologous recombination. pag1 expresses a microRNA that suppresses the expression of the viral transcription factor, hhi-1, an RNA intermediate necessary to maintain latency in HzNV-1 (Chao, 1998; Wu and Wu, 2011). To inactivate the pag1 gene, a pUC57-based transfer vector, yfp-pUC57, was designed and synthesized with the yfp gene controlled by the *Orgyia pseudotsugata* multicapsid nuclear polyhedrosis virus immediate early 2 (OpIE2) promoter, and flanked by 1.2 kb of viral HzNV-2 sequences upstream and downstream of pag1.

Figure 6:
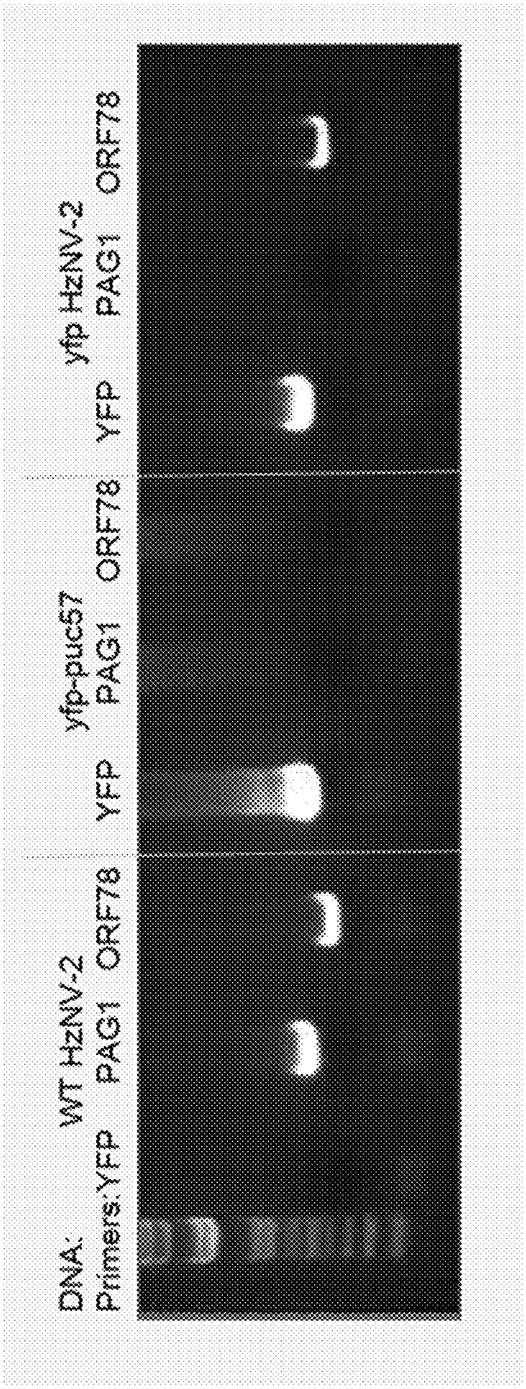
FIG. 6. 1.5% agarose gel showing PCR results that yfp HzNV-2 is a pag1 mutant. Wild-type (WT) HzNV-2 (control) and yfp HzNV-2 viral DNA and yfp-pUC57 (control), the plasmid used for homologous recombination to make the yfp HzNV-2 virus, were used as DNA templates in the PCR reactions. If present, yfp primers were used to amplify the yellow fluorescent protein gene (547 bp); pag1 primers were used to amplify pag1 DNA; ORF78 primers were used to amplify hypothetical gene ORF78 (403 bp) that the DNA is from HzNV-2.

The yfp HzNV-2 recombinant virus was generated by homologous recombination of yfp/pag1-pUC57 plasmid with WT HzNV-2 genomic DNA after transfection into Sf9 insect cells. The mutant virus was plaque purified, screened for YFP fluorescence using a Zeiss observer A1 fluorescent microscope and the AxioVision Rel. 4.6 program, and amplified in Sf9 cells in nudivirus media (lx Supplemented Grace's Media, 7% FBS, 1% Penicillin/streptomycin) in 25 $cm^2$ tissue culture flasks. Viral DNA was isolated from the cell culture supernatant using DNAzol (ThermoFisher Scientific #10503027) and PCR was performed using the AmpliTaq Gold master mix (ThermoFisher Scientific #4398881). PCR results confirmed deletion of pag1 and presence of the yfp gene using internal pag1 (F 5'-GTGGTGCCAGACTTTCAGACATCAT-3'(SEQ ID NO: 10), R 5'-GGGTCTGTTGCGACCTAAAGGTCTA(SEQ ID NO: 11)) and yfp (F 5'-CGAAGAGCTCTTCACTGGCGTGGT-3'(SEQ ID NO: 12), R 5'-GGTGTTTTGCTGGTAATGATCCGC-3' (SEQ ID NO: 13)) primers, respectively (FIG. 6). Subsequent PCR reactions detected pag1 DNA indicating that the yfp HzNV-2 virus is a yfp insertional mutant rather than a complete replacement of this gene. Nevertheless, inactivation of pag1 was sufficient to produce a virus that caused sterility in up to 100% of infected insects. Primers to the HzNV-2 open-reading frame ORF78 (F 5'-GCACACCTATCGATCACCAT-3', R 5'-GCACGATTCGTAATGTTCAAGG-3') were used as a control for detecting the HzNv-2 genome.

Method of Targeting Mutations in a Nudivirus Genome

Applicant has developed a novel method using diepoxybutane (DEB) to produce deletions in nudivirus genomes by chemical mutagenesis. DEB is known to crosslink DNA and lead to deletions of multiple bases (from ~50 bases to several kilobases), often within a single gene (Reardon et al., 1987; Wijen et al., 2001). DEB tends to cause mutations within regions of DNA that are actively transcribed. However, published protocols for DEB mutagenesis do not teach mutating a nudivirus as it infects an insect cell so that genes involved in establishing viral lysogeny are preferentially mutated. In the literature, DEB mutagenesis usually involves feeding DEB to insects (Reardon et al., 1987, Genetics 115:323-331; Kimble et al., 1990 Genetics. 1990 December; 126(4):991-1005; Olsen and Green 1982 *Mutat Res.* 1982

Feb. 22; 92(1-2):107-15), or exposing DNA directly to the mutagen (Yazaki et al., J Virol Methods. 1986 November; 14(3-4):275-83). See also Gherezghiher et al. (J Proteome Res 2013, 12(5):2151-2164), Kempf et al. (Biosci Rep 1990 10(4):363-374), "Methods of identifying anti-viral agents" U.S. Pat. No. 7,476,499), which relate to chemical mutagenesis, but which do not describe methods for targeting viral mutations to selective classes of viral genes as disclosed herein. The art does not teach the use of DEB to mutate nudivirus genomes during an infection or methods to target viral genes by synchronizing chemical exposure with stages of the virus infection process in cells. Disclosed herein is a novel method that addresses one or more of the following objectives: 1) efficient mutation in early expressed genes in the HzNV-2 genome, 2) introducing a mutation while avoiding viral DNA damage to a level that compromises virus replication, 3) introducing a mutation while avoiding killing the virus-infected host Sf9 insect cell, and 4) allowing recovery of virus mutants before host cells lyse and the virus becomes unstable (typically in less than 48 h).

Applicant established an efficient protocol, wherein Sf9 cells were infected with WT HzNV-2 at a multiplicity of infection (MOI) of 1 for 1.5 hrs. The 1.5 hr incubation time was chosen because previous literature illustrated that 2 h was enough time for the related HzNV-1 virus (SEQ ID NO: 2) to enter Sf21 insect cells and to transcribe the pag1 gene (Chao et al., 1992. J Virol 66(3):1442-1448). Applicant found that one barrier to an effective method was allowing sufficient time for the virus to enter into the target cell (the insect cell) and start viral transcription. Without intending to be limited by theory, Applicant found that about 1.5 hours was sufficient to achieve this objective. In other aspects, the infection time may be about 45 minutes or more, or about one hour to about two hours. Following this step, 0.1 mM DEB is added to the culture. Applicant found that, at higher concentrations of DEB (equal to and greater than about 0.5 mM), the host cell (for example, Sf9 cells) could not survive. A range of from about 0.05 mM to about 0.1 mM DEB is considered sufficient to carry out the protocol. The cells were harvested by centrifugation after a three hr incubation and re-suspended in fresh medium. Applicant found that three hours was sufficient to cause mutagenesis but not kill host insect cells. In other aspects, the infection time may be about four to five hours.

Plaque assays are performed to isolate mutated viruses, which are then amplified in Sf9 cells and evaluated for cell lysis. A mutation in a locus required for the virus latent phase, such as the pag1 region, should result in increased cell lysis because infected cells do not enter a latent phase. Increased lysis of virus-infected cells could be evident from observations of viral plaque morphology in which lytic virus mutants were larger than wild type virus plaques. Following the protocol, Applicant found that almost half of DEB-treated viral plaques (26 of 66) had a large plaque phenotype. The plaques may be preserved as DEB-mutant HzNV-2 viral stocks. 31 DEB-treated viruses were further screened to determine if they caused agonadal female moths. Briefly, $3^{rd}$ instar larvae were inoculated with a pre-sterilized pin dipped in mutant viral supernatants collected from cell culture. Larvae were reared to adults, and female moths were evaluated for the ability to lay eggs and for the presence of a viral plug. Applicant found that 11 of the 31 mutants (KS-3, KS-38, KS-39, KS-40, KS-45, KS-49, KS-50, KS-51, KS-54, KS-57, KS-65) caused a higher percentage of agonadal females than WT virus and one virus (KS-52) led to lower egg production. The outcome of the DEB mutagenesis was surprisingly efficient; 36% of the 30 viruses caused more agonadal females than the WT virus in the in vivo screen. Random mutation of the HzNV-2 genome would be expected to rarely affect latency because only two of more than 113 viral genes are known to have a role in establishing the latency. In the described method, however, approximately ⅓ of mutants appeared to alter or eliminate the latent phase.

A detailed exemplary method is as follows:

Culture conditions. Seed Sf9 insect cells at $2.5\times10^6$ cells/ml in 2 mL with nudivirus media (lx Supplemented Grace's Media, 7% FBS, 1% Penicillin/streptomycin) in a 25 $cm^2$ tissue culture flask. Then 3 mL wild-type HzNV-2 virus previously amplified in tissue culture at an estimated MOI of 1 is added.

WT HzNV-2 virus was amplified by first seeding Sf9 insect cells in all wells of a 6-well culture dish at $8\times10^5$ cells/ml in 2 ml nudivirus media. After a 1 hr incubation at 27° C., 50 μl of filtered WT HzNV-2 obtained from a viral plug of agonadal female moth (acquired the same day) was added to each well using a large bore tip. Plates were incubated for 2 days at 27° C. Viral supernatants were then collected, cells and debris were removed by centrifugation (900×g, 10 min, 4° C.), and supernatants from all wells were filter sterilized using a 0.22 μm filter and combined. The approximate viral titer from the procedure is $1.5\times10^6$ pfu/ml.

To isolate the WT HzNV-2 from infected female moths, the viral plug from an infected female moth is first extracted from the body and moved to a 1.5 ml-microcentrifuge tube. 100 μl 1×PBS is added and the plug is homogenized manually with a pipette tip to release the virus. The large fragments of insect cuticle and tissue are then removed. This viral solution is termed unfiltered viral plug extract (UVPE). The filtered viral plug extract (FVPE) is a filtered solution (with a 0.22 μm filter) of 1× supplemented Grace's media, 2% unfiltered viral plug extract, and 5% penicillin/streptomycin antibiotics.

Controls for this mutagenesis are performed in parallel. Controls included uninfected Sf9 culture, uninfected Sf9 culture treated with DEB, and virus-infected Sf9 culture. These cultures are prepared the same way and at the same time as the mutagenized culture described herein.

The infected Sf9 insect culture is incubated at 27° C. for 1.5 hours.

Chemical Mutagenesis

In a fume hood, DEB (other names 1,3-butadiene diepoxide or 1,2,3,4-Diepoxybutane) is added at a 0.1 mM final concentration to the culture. The culture is then incubated at 27° C. for 3 hours.

After the 3 h incubation, the culture is moved to the fume hood. A cell scraper is used to detach cells from the 25 $cm^2$ flask. The cells and supernatant are moved to a 50 ml-conical tube and centrifuged at 900×g for 10 min at 4° C. The supernatant is removed to a specified waste container. Cells are washed with 10 ml PBS, incubated in fume hood for 5 min, then spun down at 900×g for 10 min at 4° C.

The wash supernatant is removed to a specified waste container. The cell pellet is then resuspended in 5 ml nudivirus media and moved to a new 25 $cm^2$ tissue culture flask, which is now considered DEB-free. Culture is incubated at 27° C. for 2 d.

After 2 days, the cell culture medium containing DEB-exposed HzNV-2 is collected after culture centrifugation at 900×g for 10 min and filter sterilization using a 0.22 μm filter. 2 ml of the virus stock is added to a new 25 $cm^2$ tissue culture flask containing Sf9 insect cells that were seeded at $1\times10^6$ cells/ml in a 5 ml total volume with nudivirus media. The virus-infected culture is incubated at 27° C. for 7 d.

To purify and amplify the virus to a suitable volume for insect infection, the virus-containing medium was collected after centrifugation (3000 rpm, 10 min, 4° C.), filter sterilized using a 0.22 μm filter, and stored in 1 mL aliquots at −80° C. The titer of the virus is approximately $1\times10^4$ pfu/mL While HzNV-2 has been shown to infect several lepidopteran cell lines including Sf-9 and TN-368 cells, Applicant found that it is difficult to pass the virus in insect cells due to the virus causing quick cellular lysis. The disclosed methods allow for amplification of the virus to a volume that allows for both amounts sufficient virus for storage and also virus suitable for insect infection.

Viruses were isolated using a traditional plaque assay, described in, for example, Anderson, D., Harris, R., Polayes, D., Ciccarone, V., Donahue, R., Gerard, G., and Jessee, J. (1996) Rapid Generation of Recombinant Baculoviruses and Expression of Foreign Genes Using the Bac-To-Bac® Baculovirus Expression System. Focus 17, 53-58. Large plaques, referred to as the p0 viruses, were further amplified.

For p0 to p1 amplification, Sf9 insect cells were seeded at $5\times10^5$ cells/ml in a final 2 ml volume with nudivirus media in 12-well culture plates and incubated at 27° C. for 1 h. Afterwards, viral plaques were picked using a large bore pipette tip and transferred to one well. Plates were incubated at 27° C. for 5 d. Medium containing DEB-treated HzNV-2 virus is collected after culture centrifugation (900×g for 10 m at 4° C.) and filter sterilized using a 0.22 μm filter.

For p1 to p2 amplification, Sf9 insect cells were seeded at $8\times10^5$ cells/ml in a final 2 ml volume with nudivirus media in 6-well culture plates and incubated at 27° C. for 1 h. Afterwards, 600 μl p1 virus was added to one well using a serological pipet. Plates were incubated at 27° C. for 4 d. Medium containing DEB-mutated HzNV-2 was then collected after culture centrifugation (900×g for 10 m at 4° C.).

For p2 to p3 amplification, Sf9 insect cells were seeded at $1\times10^6$ cells/ml in 5 ml with nudivirus media in 25 $cm^2$ tissue culture flask with no incubation. ~1.5 ml (or all) p2 virus was added to one flask using a serological pipet. Flasks were incubated at 27° C. for 4 d. Medium containing DEB-mutated HzNV-2 is then collected after culture centrifugation (900×g for 10 min at 4° C.) and filter sterilization using a 0.22 μm filter. p3 virus is stored in 1 ml aliquots at −80° C.

p3 virus was used to infect $3^{rd}$ instar larvae via the direct inoculation method. Each mutant virus caused an infection in the insect leading to formation of a viral plug found in agonadal female moths. Virus from these viral plugs may be used in subsequent experiments.

Confirming Sterilizing Activity of Recombinant and Chemically Mutated HzNV-2 Virus Taken together, the data demonstrate that recombinant and mutant HzNV-2 viruses can be effectively achieved using one or more of the above-described methods. Recombinant and mutant HzNV-2 viruses having a disrupted latency phase may be produced in which genes that affect the latency phase are disrupted or structural genetic elements required to establish or break latency are altered. The resulting genetically modified mutant HzNV-2 viruses cause elevated levels of sterility in infected *H. zea* moths. In one aspect, the genes that are disrupted include one or more of pag1, ORF 90, and ORF92. It is noted that 100% sterile phenotypes may be produced by mutating different viral genes and regions of the viral genome.

TABLE 1

Locations of mutations in the chemical mutants relative to HzNV-2. Wild-type (WT) HzNV-2 virus was mutated with DEB to form HzNV-2 chemical mutants. Mutants KS-3, KS-45, and KS-51 were sequenced and gene deletions were identified. It is notable that the three mutants have mutations in a region that is not present in the HzNV-1 genome.

| HzNV-2 strain | WT base pairs affected | WT genes affected |
|---|---|---|
| yfp HzNV-2 | 210,631-214,753 bp | pag1 |
| KS-3 | 48 bp insertion at bp 175,550 | ORF90, hypothetical protein |
| KS-45 | 80 bp insertion at bp 175,650 | ORF90, hypothetical protein |
| KS-51 | 180,270-180,299 deletion | ORF92, hypothetical protein |
| | 77 bp insertion at bp 109,598 | Intergenic DNA between hypothetical proteins ORF55 and ORF56 |

The sterilizing activity of the resulting mutants were assessed through many experiments in which virus was injected into *H. zea* adults or 3rd instar larvae. In a typical experiment, WT-HzNV-2, the recombinant yfp HzNV-2, and mutant KS3 viruses were collected and purified from viral plugs found in virus-infected female moths and then injected into new healthy female moths 2 days after emergence. The eggs laid on oviposition day 3 were collected and the F1 progeny female adults were analyzed for sterility as indicated by the presence of a viral plug and number of eggs laid (Table 2). Both female groups infected with mutants yfp HzNV-2 and KS-3 laid few or no eggs and had a much higher percentage of agonadal females than the WT-infected group. Thus, the viruses obtained using the described methods are suited for use in sterilizing populations of pests susceptible to infection by the described viruses, and may be utilized to control pest populations.

TABLE 2

Injection of female moths with mutant HzNV-2 KS3, recombinant mutant yfp HzNV-2, or wild-type (WT) HzNV-2 and analyses of their female offspring for sterility as determined by the presence of a viral plug and production of eggs.

| Virus | Plugs | Eggs laid |
|---|---|---|
| WT HzNV-2 | 34% | many |
| KS3 | 95% | a few |
| yfp HzNV-2 | 100% | none |

Figure 2:
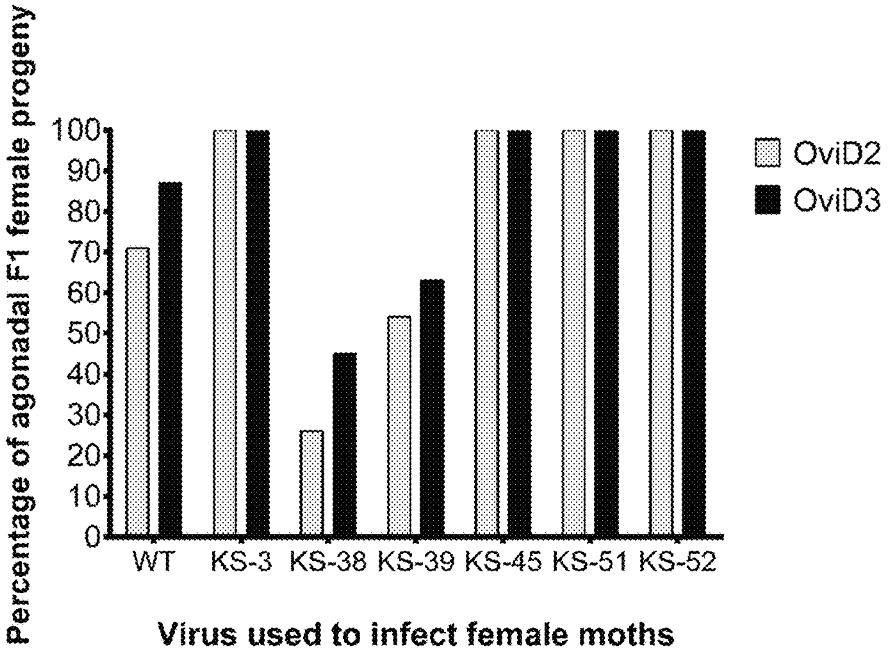
FIG. 2. Percentage of agonadal female F1 progeny. Wild-type (WT) and mutant HzNV-2 generated by chemical mutagenesis (KS-3, KS-38, KS-39, KS-45, KS-51, and KS-52) were injected into adult female moths on the day of emergence, and eggs were collected on oviposition days 2 (OviD2) and 3 (OviD3). Female F1 progeny were reared to adult moths and evaluated for the presence of a viral plug indicating an agonadal pathology (OviD2-WT n=17, KS-3 n=24, KS-38 n=23, KS-39 n=26, KS-45 n=19, KS-51 n=14, KS-52 n=18; OviD3-WT n=15, KS-3 n=16, KS-38 n=22, KS-39 n=16, KS-45 n=19, KS-51 n=18, KS-52 n=23).
Figure 3:
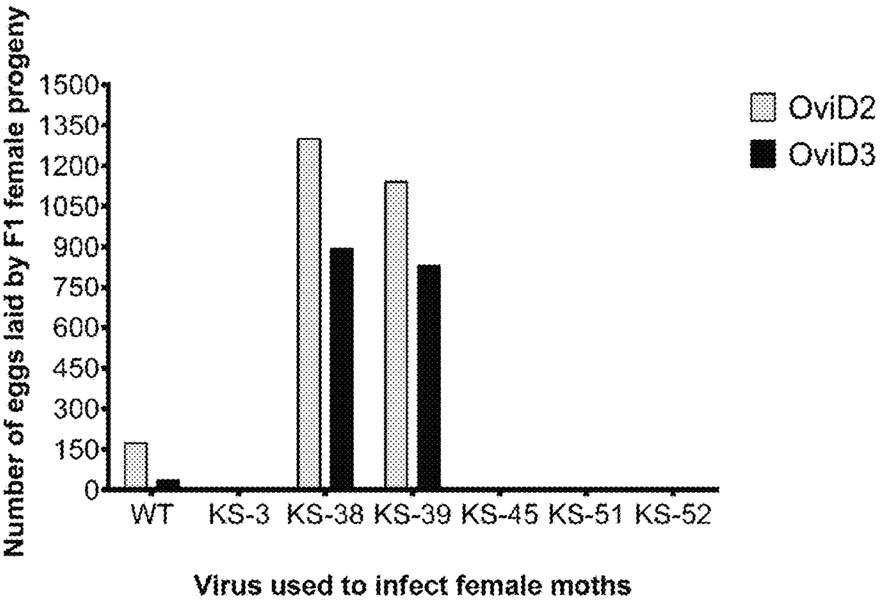
FIG. 3. Occurrence of complete sterility in agonadal female F1 progeny. Wild-type (WT) and mutant HzNV-2 (KS-3, KS-38, KS-39, KS-45, KS-51, and KS-52) were injected into adult female moths on the day of emergence, and offspring eggs were collected on oviposition days 2 (OviD2) and 3 (OviD3). Female F1 progeny were reared to adult moths and evaluated for ability to lay viable eggs. Failure to lay eggs or lay viable eggs indicates complete sterility (OviD2-WT n=17, KS-3 n=24, KS-38 n=23, KS-39 n=26, KS-45 n=19, KS-51 n=14, KS-52 n=18; OviD3-WT n=15, KS-3 n=16, KS-38 n=22, KS-39 n=16, KS-45 n=19, KS-51 n=18, KS-52 n=23). This illustrates that these mutant HzNV-2 causes decreased egg production and sterility.

In a similar experiment, WT and 9 chemical mutant viruses were evaluated for the ability to cause agonadal moths. Briefly, adult female moths were injected with 100 μl of~$10^8$ pfu/ml of virus isolated from viral plugs on the day of emergence. Eggs laid on oviposition days 2 and 3 were collected and reared to adult moths. The F1 progeny female moths were evaluated for the ability to lay eggs and the presence of a viral plug. Four mutants (KS-3, KS-45, KS-52, KS-51) caused viral plug formation in 100% of the F1 female progeny (FIG. 2). No eggs were laid by F1 female progeny of female moths infected with the three mutants (indicative of an agonadal phenotype (KS3, KS45, KS51) (FIG. 3). F1 female progeny of female moths infected with another mutant KS52, laid fewer eggs than F1 female progeny of female moths infected with WT virus on oviposition day 2 and no eggs on oviposition day 3.

The functional mutations defined by the applicant, KS-3, KS-45 and

KS-51, identify and localize to ORFs that have several unrelated direct repeated sequences ranging from 24 to 81 bp in size and having these sequence repeated from 4 to 12 times. These repeated sequences were identified by Burand et al., (2012). Such repeated sequences may have structural as well as coding roles and with some functions of repeated sequences involving recognition sites for DNA proteins and directing conformational changes of DNA that can promote DNA replication, DNA recombination and/or RNA transcription as examples. A similar repeated sequence exists in ORF 2 (direct repeat 1; Table 2; Burand et al., 2012) and is claimed herein as an identified sequence, region and ORF that is susceptible to mutation and such mutations are likely to impact DNA replication and recombination and the function of the virus relative to its effects on viral lysogeny and increased sterility among *H. zea* infected with mutations that alter ORF2 (SEQ ID NO: 3). It is notable that the 3 mutations defined by the applicant localize to ORFs 90 and 92 which contain 4 of the 6 repeated sequences in the HzNV2 genome. ORF 2 and ORF 91 contain the only other large repeated sequences in the viral genome and are thus obvious candidates for mutagenesis with an expectation that it would impact HzNV2 replication and lysogeny.

Table 2 shows additional data that compares genetically engineered and chemical mutant viruses. Progeny female moths developing from female moths infected with the genetically engineered recombinant virus, yfp HzNV-2 did not lay eggs and all F1 female progeny had viral plugs indicating their sterility. Similarly, essentially all F1 progeny of female moths infected with the chemical mutant viruses KS3, KS45, KS51, and KS52 had viral plugs and exhibited sterility (Table 2, FIGS. 2 and 3). By contrast, much smaller percentages (~33%) of insects infected with WT virus were agonadal (had plugs) with most moths infected with the WT HzNV-2 being fertile and laying many eggs (Table 2, FIG. 3). Similar results are seen on other oviposition days, although the number of female sterile moths in the F1 progeny of female moths injected with WT HzNV-2 increases at later oviposition days as reported in the literature (Hamm et al., 1996; Burand 2013). These results support the hypothesis that inactivation of several nudivirus genes, for example, pag1 (SEQ ID NO: 6), ORF90 (SEQ ID NO: 4), and ORF92 (SEQ ID NO: 5) can cause sterility in essentially 100% of infected insects.

While it is to be recognized that viruses capable of being sexually transmitted among an insect pest species, can be mutated and selected using the described protocols without knowledge of specific genes involved in the phenotype of the resulting virus (for example, using the DEB protocol described above), some genes associated with increased sterility following viral infection have been identified by the Applicant. For example, the pag1, ORF 90, and ORF92 genes have been found by Applicant to be associated with increased sterility in virus-infected insects.

Infection of an Insect Using Modified HzNV-2

Published nudivirus literature describes various techniques for infecting and sterilizing *H. zea* moths with WT HzNV-2 but are lacking in various aspects such that a meaningful protocol can be carried out. Applicant has developed protocols that efficiently 1) infect the adult moth, 2) infect the moth offspring, and 3) mimic natural infections of moth populations in the field.

Method of Sterilizing the Offspring of Adult Moths. A Protocol for Producing Agonadal Infections with WT HzNV-2.

To infect adult moths, the virus is injected into the abdomen of adult moths using an insulin syringe. In such experiments, WT virus collected from a viral plug effectively infected female adult moths and F1 progeny mimicking natural infected moth populations (i.e. 20-50% agonadal) (Table 3). Virus is collected by removing the plug from the abdominal area and suspending the plug in 100 μl PBS; this is called the unfiltered viral plug extract (UVPE). The virus is then diluted to 2% in 1× Grace's media and filtered through a 0.22 micron filter to sterilize; this is called the filtered viral plug extract (FVPE). Applicant determined there was no difference in the percentage of agonadal F1 progeny when using either UVPE or FVPE for injections. (Table 3.) Applicant used FVPE for most experimentation.

TABLE 3

Comparison of unfiltered viral plug extract (UVPE) and filtered viral plug extract (FVPE) in their ability to cause agonadal F1 progeny with plug. Oviposition day is the day the infected female moth laid eggs. Eggs laid on oviposition days 3 and 4 were reared to adults.

| Oviposition day | Virus type | # Females evaluated for plug | F1 progeny females with plug |
|---|---|---|---|
| 3 | UVPE | 40 | 33% |
| 3 | FVPE | 25 | 36% |
| 4 | UVPE and FVPE | 35 | 74% |

Developing the Protocol to Generate a High Number of Agonadal Moths

Subsequent experimentation determined that injecting virus extracted from viral plugs results in a higher percentage of agonadal F1 progeny than injecting virus produced from infections of Sf9 cells in culture. Briefly, adult female moths were injected with 50-60 μl of either FVPE or virus amplified in cell culture. Eggs were collected on oviposition day 3 and reared to adults. F1 female progeny were evaluated for the presence of a plug. Almost all of the F1 female progeny developed a plug if F0 female moths were injected with viral plug extract, whereas only 10% of F1 progeny developed a plug if injected with virus collected from infected Sf9 cells. (Table 4).

TABLE 4

Comparison of virus isolated from infected Sf9 insect cells (cell culture) and isolated from viral plugs (plug virus) in their ability to cause agonadal F1 progeny as indicated by the presence of viral plugs.

| Virus type | Virus strain | # Females evaluated for a plug | F1 female progeny with plug |
|---|---|---|---|
| Cell culture | yfp HzNV-2 | 11 | 9% |
| Cell culture | KS-3 | 20 | 10% |
| Plug virus | yfp HzNV-2 | 26 | 100% |
| Plug virus | KS-3 | 20 | 95% |

Thus, the titer of virus amplified in cell culture used for infection of adult moths was not optimal. Titer is an important factor in developing a method for creating high volumes of sterile insects. The optimal viral titer will be as low as possible but sufficient to cause agonadal adults. To assess the effects of virus titer, adult female moths were injected with either $10^7$, $10^4$ or $10^1$ pfu/ml virus (WT or yfp HzNV-2) and mated with uninfected males. Eggs were collected on oviposition days 3-5, and reared to the adult stage. Moths were evaluated for the presence of a viral plug and egg production. Virus titer of $10^4$ pfu/ml led to a high number of agonadal F1 progeny on oviposition day 5 (Table 5) indicating that the virus replication in the host moth was important for effective transmission of the virus to the offspring eggs.

TABLE 5

Moths were either uninfected or infected with a low ($10^1$ pfu/ml), mid ($10^4$ pfu/ml), or high ($10^7$ pfu/ml) dose with either wild-type (WT) or recombinant yfp HzNV-2 virus. Eggs were collected on oviposition days 3-5, reared to adults, and the agonadal state of each female was evaluated by the presence of a plug.

| Virus group | Virus dose | F1 progeny collected on oviposition day | # females evaluated | # Eggs laid | F1 females with plugs |
|---|---|---|---|---|---|
| Uninfected | — | Day 3 | 7 | ~300 | 0% |
| | | Day 4 | 6 | 14 | 0% |
| | | Day 5 | 4 | 0 | 0% |
| WT-infected | $10^1$ pfu/ml | Day 3 | 9 | 5 | 0% |
| | | Day 4 | 5 | ~300 | 0% |
| | | Day 5 | 9 | 64 | 22% |
| | $10^4$ pfu/ml | Day 3 | 6 | 1 | 0% |
| | | Day 4 | 10 | ~150 | 20% |
| | | Day 5 | 10 | 0 | 100% |
| yfp HzNV-2-infected | $10^4$ pfu/ml | Day 3 | 4 | 0 | 0% |
| | | Day 4 | 4 | 0 | 0% |
| | | Day 5 | 10 | 0 | 70% |
| | $10^7$ pfu/ml | Day 3 | 9 | ~150 | 0 |
| | | Day 4 | 3 | 0 | 0 |
| | | Day 5 | 1 | 0 | 0 |

Figure 4:
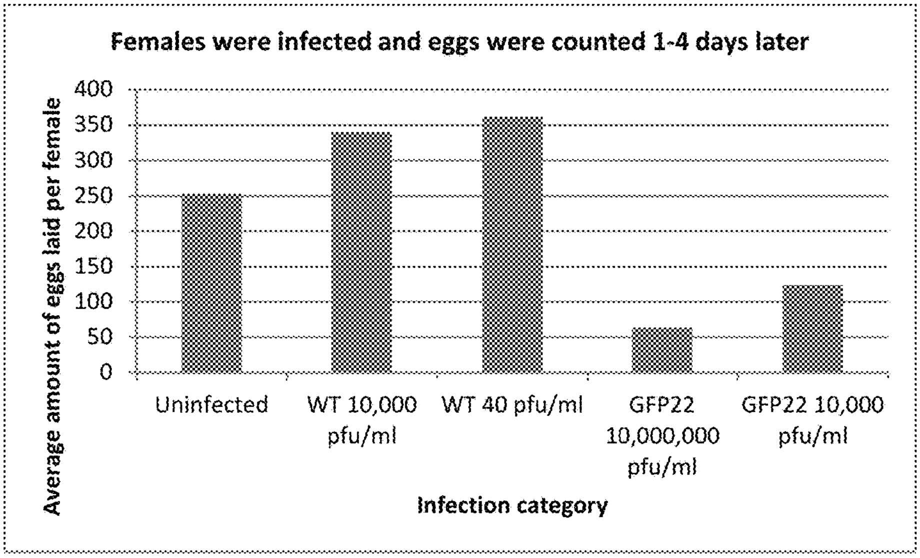
FIG. 4. Effect of viral titer on *H. zea* egg production. Female adult moths (7) were injected with 100 μl wt HzNV-2 (high dose: $4\times10^4$ pfu/ml; low dose: 40 pfu/ml) or yfp recombinant HzNV-2 (high dose: $1\times10^7$ pfu/ml; low dose: $1\times10^4$ pfu/ml) isolated from cell culture and mated with uninfected male moths (9). Eggs were collected on oviposition days 2-5 and counted. Uninfected females were mated with uninfected males as a control.

Injection of the recombinant virus into naïve male moths, followed by mating with healthy females, does not significantly reduce the number of eggs laid by female moths although the infection can be transmitted in this manner. However, when newly emerged female moths were injected with recombinant yfp HzNV-2 and mated with healthy males, the egg number was dramatically reduced (FIG. 4). This effect was dose-dependent as a viral dose of $1\times10^6$ pfu exhibited fewer eggs compared to a viral dose of $1\times10^3$ pfu. The total number of eggs laid by female moths injected with WT HzNV-2 was not reduced relative to media injected controls; this effect is only observed with the mutant and recombinant viruses.

Methods of Sterilizing Adult Moths by Injecting the Insects with Virus at the Larvae Stage An alternative protocol for inducing sterility is to inject virus into 3rd instar larvae such that the injected insects exhibit the sterile pathology as adults. While this is not the normal mode of transmission, larval injections are much faster, amenable to automation and likely mimic the activation of viral replication (Rallis et al., 2002-a). Applicant has created two protocols for inducing sterility in $3^{rd}$ instar larvae: syringe injection and direct inoculation.

Infection Using Syringe Injection

Figure 5:
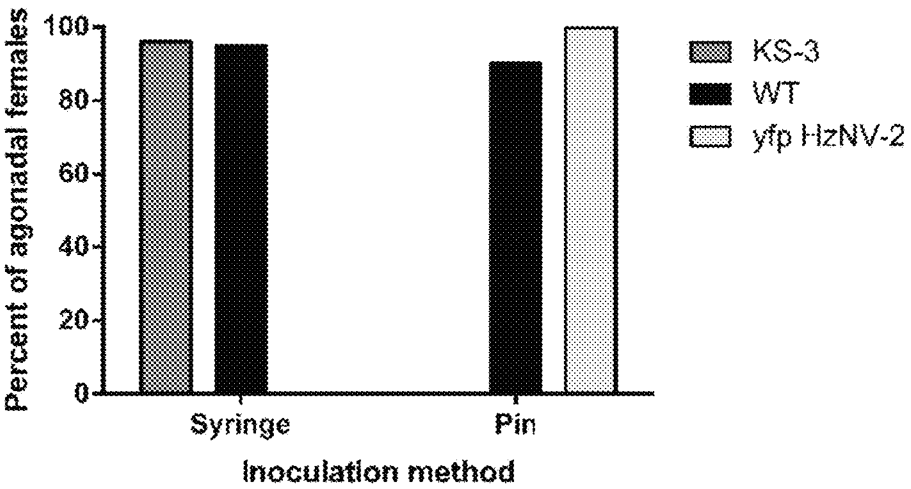
FIG. 5. Direct inoculation of insect larvae causes high numbers of agonadal moths. Wild-type (WT) HzNV-2 and mutant KS3 were amplified in Sf9 insect cell culture and injected into third instar larvae via an insulin syringe. WT HzNV-2 and mutant yfp HzNV-2 virus isolated from viral plugs of agonadal female moths were used to infect third instar larvae via a pre-sterilized pin. After both types of infections, larvae were reared to adult moths, and females were examined for the presence of a viral plug, an indicator of virus infection and agonadal pathology (Syringe, WT n=20, KS3 n=25; Pin, WT n=20, yfp HzNV-2 n=21).

Injecting supernatants from cultures of virus-infected cells into adult moths does not produce high numbers of agonadal offspring (Table 4). To determine if virus produced from infected, cultured insect cells effectively initiated productive virus infections when injected into larvae, Applicant injected virus-containing tissue culture medium into $3^{rd}$ instar larvae. $3^{rd}$ instar larvae (83 larvae per group) were injected using an insulin syringe with either WT HzNV-2, yfp HzNV-2, or KS-3 virus (25-50 μl) or not injected. Larvae were reared to adults. Surprisingly, none of the yfp HzNV-2-injected larvae pupated and eventually died (Table 6). However, ~95% of female larvae infected with either WT HzNV-2 or KS-3 virus produced a viral plug as adults (FIG. 5). Applicant concluded that while injecting virus amplified in tissue culture into adult moths does not produce many agonadal offspring, injecting virus amplified in tissue culture into $3^{rd}$ instar larvae was an effective method as almost all moths became agonadal.

TABLE 6

Larval and pupal stage mortality after injection of $3^{rd}$ instar larvae with WT HzNV-2, recombinant and mutant HzNV-2 derived from virus-infected insect cell cultures.

| Group | Insects survived injection and pupated |
|---|---|
| Uninfected | 100% |
| WT-infected | 60% |
| KS3-infected | 73% |
| yfp HzNV-2-infected | 0% |

Injection of viral plug extract into $3^{rd}$ instar larvae with an insulin syringe was also evaluated. Briefly, WT HzNV-2 and yfp HzNV-2 FVPE was diluted to $7\times10^3$ pfu/ml and $2.5\times10^2$ pfu/ml and 25 μl was injected into $3^{rd}$ instar larvae. Larvae were reared to adults and female moths were evaluated for the presence of a plug. Female moths that were injected as larvae with a titer of $10^3$ pfu/ml developed a viral plug, whereas only ~80% of those injected with $10^2$ pfu/ml developed a viral plug (Table 7). Applicant concluded that injecting $3^{rd}$ instar larvae with viral plug extract was also highly effective at developing agonadal adults, but titer should be around $10^3$ pfu/ml.

TABLE 7

Incidence of viral plugs after $3^{rd}$ instar larvae were infected with wild-type (WT) HzNV-2 or recombinant yfp HzNV-2\at viral doses between $10^2$ to $8\times10^3$ pfu/ml.

| Infection-group | Virus titer (pfu/ml) | Females with plug |
|---|---|---|
| Uninfected | 0 | 0% |
| WT-infected | $1\times10^2$ | 80% |
| WT-infected | $1\times10^3$ | 100% |
| yfp-HzNV2-infected | $4\times10^2$ | 79% |
| yfp-HzNV2-infected | $8\times10^3$ | 100% |

Infection Using Direct Inoculation Using a Pin

Direct injection of third instar larvae or moths are efficient methods for infecting HzNV-2 in the laboratory, but feeding is a preferred method.

Infecting *H. zea* with WT HzNV-2 via an oral route of infection is possible. Raina et al. (2006) fed WT HzNV-2 to $1^{st}$ instar larvae for 1-3 days and found that 9-17% (varies based on gender and duration of feeding) of adults became agonadal. Hamm et al. (1996) fed WT HzNV-2 to adult moths in an aqueous solution and from 60-100% of the offspring adults were agaondal. The HzNV-2 genome also encodes genes related to four baculovirus genes (p74, pif-1, pif-2, and pif-3) whose protein products are involved in viral entry per os (Burand, Kim, Afonso et al. 2012). Although the natural route of infection for HzNV-2 is through mating and/or transovarial transmission, other methods for infecting insects include direct inoculation and feeding of both larvae and adults.

A direct inoculation method for transmitting the virus to $3^{rd}$ instar larvae (Table 8) was developed and may be amenable to automation. This method is similar to that used by Hamm et al., (1996) to infect $1^{st}$ instar larvae with viral plug extract with 9 of 10 larvae becoming agonadal as adults. Direct inoculation is a rapid means to introduce virus into *H. zea* larvae in which a sterile pin is dipped into the viral solution and then used to prick larvae between the head capsule and abdomen with sufficient force to penetrate the cuticle and enter the insect's body cavity. WT HzNV-2 (A, B) virus obtained from two different cell culture infections A and B) were used for direct inoculation. The pricked larvae were reared to adult moths, and female moths were evaluated for the presence of a plug. 57% (WT A) and 16% (WT B) of moths were agonadal.

To test virus isolated from plugs, ~$10^8$ pfu/ml of WT HzNV-2 or recombinant yfp HzNV-2 viruses were isolated, filter sterilized and used in direct inoculation experiments. The inoculated larvae were reared to adult moths and mated. All female moths developing from larvae inoculated with recombinant yfp HzNV-2 were sterile (no eggs laid; plugs in 100% of females). Upon dissection, all male moths examined were found to be agonadal.

For larvae inoculated with WT HzNV-2, 90% of female moths had a viral plug with the number of eggs laid commensurately reduced relative to controls (Table 8). In summary, the direct inoculation method not only was as efficient as injecting the virus into larvae, it also was much faster.

TABLE 8

Effects of direct inoculation of $3^{rd}$ instar larvae with wild-type (WT) and yfp recombinant HzNV-2 purified from viral plugs on moth sterility.

| Group | # of eggs laid* | % Female moths with plugs | State of reproductive organs in male moths** |
|---|---|---|---|
| Unpricked | High | 0 | 0% agonadal |
| Medium control | High | 0 | 0% agonadal |
| WT HzNV-2 | Low | 90 | 50% agonadal |
| yfp HzNV-2 | None | 100 | 100% agonadal |

*high: >700 eggs; low <200 eggs;

**determined by dissecting reproductive organs of *H. zea* males.

To investigate effects of titer on the direct inoculation method WT HzNV-2 isolated from a viral plug was diluted to $10^6$ pfu/ml and used to inoculate $3^{rd}$ instar larvae. Only 18% of WT-HzNV-2 pricked females were agonadal with the $10^6$ pfu/ml inoculum. Many females, termed carriers, are infected with virus but have inactive or latent infections. Moths having latent infections have intact, functional reproductive tracts but can transmit the virus horizontally and vertically to their offspring. PCR using a primer set to the HzNV-2 ORF78 was performed, and all 20 of the females without viral plugs tested were carriers. Applicant concluded that use of direct inoculation with a lower titer of $10^6$ pfu/ml to infect $3^{rd}$ instar larvae created a carrier population.

Method of Infecting an Insect with the Disclosed Viruses

Alternative methods for introducing insect nudiviruses and baculoviruses are reported in the scientific and patent literature. The literature suggests that efficient infection is possible by feeding newly emerged (neonate) first instar larvae, by feeding adults virus in a sucrose solution, by adding fluorescent brighteners to larval diet, or by aerosol infections with virus in powdered or droplet form (Kirkpatrick et al., 1994; U.S. Pat. No. 7,261,886). A recent patent filing reports efficient baculovirus infection achieved by immersing larvae in a viral solution (US Patent Publication US2011/0314562).

In accordance with the instant disclosure, three different methods for infecting large numbers of larvae may be used as follows:

1. Virus Feeding. The protocol used by Raina and Lupiani (2006) may be used. Briefly, newly hatched *H. zea* larvae may be placed in a 100×15 mm Petri dish containing a diet with 1000 pfu of mutant HzNV-2. To increase the efficient uptake of the virus, the fluorescent brightener Blankophor may be added to the diet (Martinez et al., 2009). The larvae may be allowed to feed for 48 hrs then placed in diet-containing cups. *H. zea* is very cannibalistic and so must be housed individually at a young instar. The pupae will be sexed and emerged females will be analyzed for viral plugs, the ability to lay fertile eggs after mating, and the presence of intact reproductive organs.

The males may then be dissected and their reproductive organs examined to determine if they are agonadal. The presence of mutant HzNV-2 may be confirmed by PCR, as described above.

2. Virus Aerosols. The virus may be delivered as a lyophilized powder (Kirkpatrick et al., 1994) or as an aqueous mist (U.S. Pat. No. 7,261,886). 3rd instar *H. zea* larvae may be anesthetized with $CO_2$ and placed in a test chamber. The lyophilized mutant virus may be placed in the chamber at different doses and dispersed continuously throughout the chamber by a gentle stream of air, for a total exposure time of 30 min. Each insect may be sexed after they pupate, and after emergence, each moth may be analyzed for sterility as described above. For the aqueous mist deliver, a Potter precision laboratory spray tower (Burkard Scientific) may be used, and 3rd instar larvae may receive doses of mutant HzNV-2 from $10^2$ to $10^4$ pfu/ml. Agonadal pathology may be assessed in adult moths.

3. Immersion. *H. zea* larvae may be submerged in a HzNV-2 solution as described by Lu et al. (2011). This treatment method involves first stressing the insects at 4° C. for 15 hours before soaking the 3rd instar larvae in different concentrations of mutant HzNV-2 ($10^3$-$10^6$ pfu/ml) for 1 hr. Sterility in adult moths may be determined as described above.

Method of Protecting a Crop from Pest Insects

The instant disclosure addresses a method for control of lepidopteran pest moths by rendering them sterile from infection with mutant or transgenic HzNV-2. The delivery of HzNV-2 or a mutant form thereof in accordance with the disclosed methods and compositions to the targeted population may be through established methods for release of moths for sterile insect control. In one aspect, the moths or other pest infected with a mutant virus as disclosed herein, are released at point locations and permitted to disperse over a range. The range may be, for example, about 800 meters from the release site or released aerially from planes, helicopters or drones. Moths infected with mutant or recombinant HzNV-2 may be released after infection using one or more of the disclosed methods at ratios from 0.1 infected moths/WT moth in the field population moth up to 10 infected moths/WT moth in the field population. Targeted release at lower ratios may rely on generational transmission of the infection for control and may require supplemental release on virus-infected adult moths.

REFERENCES

Adamo, S. A., Kovalko, I., Easy, R. H., and Stoltz, D. (2014). A viral aphrodisiac in the cricket *Gryllus texensis*. J Exp Biol. 217(Pt 11): 1970-1976, PMID: 24625650.

Ali, M. I., and Luttrell, R. G. (2007). Susceptibility of bollworm and tobacco budworm (Lepidoptera: Noctuidae) to Cry2Ab2 insecticidal protein. J Econ Entomol 100: 921-931, PMID:17598557.

Ali, M. I., Luttrell, R. G., and Young, S. Y. 3$^{rd}$ (2006). Susceptibilities of *Helicoverpa zea* and *Heliothis virescens* (Lepidoptera: Noctuidae) populations to CrylAc insecticidal protein. J Econ Entomol 99: 164-175, PMID: 16573337.

Arneodo, J. D., Balbi, E. I., Flores, F. M., and Sciocco-Cap, A. (2015). Molecular identification of *Helicoverpa armigera* (Lepidoptera: Noctuidae: Heliothinae) in Argentina and development of a novel PCR-RFLP method for its rapid differentiation from *H. zea* and *H. gelotopoeon*. J Econ Entomol 108(6): 2505-2510, PMID: 26318007.

Bedford, G. O. (2013). Biology and management of palm dynastid beetles: recent advances. Annu Rev Entomol. 58: 353-372, PubMed PMID: 23317044.

Berge, J. B., and Ricroch, A. E. (2010). Emergence of minor pests becoming major pests in GE cotton in China: what are the reasons? What are the alternatives practices to this change of status? GM Crops. 1(4): 214-219, PMID: 21844676.

Bézier, A., Thézé, J., Gavory, F., Gaillard, J., Poulain, J., Drezen, J. M, and Herniou, E. A. (2015). The genome of the nucleopolyhedrosis-causing virus from *Tipula oleracea* sheds new light on the Nudiviridae family. J Virol. 89(6): 3008-3025, PMID: 25540386.

Burand, J. P. (2013). Pathology and replication of the sexually transmitted insect virus HzNV-2. *Advances in Virus Research*. ISBN: 978-1477555-04-0. iConcept Press.

Burand, J. P., Kim, W., Afonso, C. L., Tulman, E. R., Kutish, G. F., Lu, Z., and Rock, D. L. (2012). Analysis of the genome of the sexually transmitted insect virus *Helicoverpa zea* nudivirus 2. Viruses 4: 28-61, PMID:22355451.

Burand J. P., Tan, W., Kim, W., Nojima, S., and Roelofs, W. (2005). Infection with the insect virus Hz-2v alters mating behavior and pheromone production in female *Helicoverpa zea* moths. J Insect Sci. 5: 6. PMID: 16299596.

Burand, J. P., and Rallis, C. P. (2004). In vivo dose-response of insects to Hz-2V infection. Virology journal 1: 15, PMID:15613241.

Burand, J. P., Rallis, C. P., and Tan, W. (2004). Horizontal transmission of Hz-2V by virus infected *Helicoverpa zea* moths. J Invertebr Pathol 85: 128-131, PMID:15050843.

Burand, J. P., and Lu, H. (1997). Replication of a Gonad-Specific Insect Virus in TN-368 Cells in Culture. J Invertebr Pathol. 70(2): 88-95. PMID: 9281395.

Burand, J. P., and Wood, H. A. (1986). Intracellular protein synthesis during standard and defective Hz-1 virus replication. J. Gen. Virol. 67: 167-173.

Burand, J. P., Stiles, B., and Wood, H. A. (1983). Structural and Intracellular Proteins of the Nonoccluded Baculovirus HZ-1. J Virol. 46(1): 137-142. PMID: 16789238.

Burand, J. P., Wood, H. A., and Summer, M. D., (1983). Defective particles from a persistent baculovirus infection in *Trichoplusia ni* tissue culture cells. J. Gen. Virol. 64: 391-398.

CABI 2015 http://www.cabi.org/isc/datasheet/26776

Campagne, P., Kruger, M., Pasquet, R., Le Ru, B., and Van den Berg, J. (2013). Dominant inheritance of field-evolved resistance to Bt corn in Busseolafusca. PLoS One 8: e69675, PMID:23844262.

Capinera 2000, revised 2007 UF/IFAS Extension http://entomology.ifas.ufl.edu/creatures.

Carriere, Y., Crowder, D. W., and Tabashnik, B. E. (2010). Evolutionary ecology of insect adaptation to Bt crops. Evol Appl 3: 561-573, EPA (1998). The Environmental Protection Agency's White Paper on Bt Plant-pesticide Resistance Managment (EPA).

Chao, Y. C., Lee, S. T., Chang, M. C., Chen, H. H., Chen, S. S., Wu, T. Y., Liu, F. H., Hsu, E. L., and Hou, R. F. (1998). A 2.9-kilobase noncoding nuclear RNA functions in the establishment of persistent Hz-1 viral infection. J Virol. 72(3): 2233-2245. PMID: 9499081.

Chao, Y. C., Wood, H. A., Chang, C. Y., Lee, H. J., Shen, W. C., and Lee, H. T. (1992). Differential expression of Hz-1 baculovirus genes during productive and persistent viral infections. J Virol. 66(3): 1442-7448. PMID: 1738201.

Chen, H. H., Tsai, F. Y., Chen, C. T. (2001). Negative regulatory regions of the PAT1 promoter of Hz-1 virus contain GATA elements which associate with cellular factors and regulate promoter activity. J Gen Virol. 82(Pt 2): 313-320. PMID: 11161268.

Cheng, C. H., Liu, S. M., Chow, T. Y., Hsiao, Y. Y., Wang, D. P., Huang, J. J., Chen, H. H. (2002). Analysis of the complete genome sequence of the Hz-1 virus suggests that it is related to members of the Baculoviridae. J Virol. 76(18): 9024-9034. PMID: 12186886.

Cheng, R. L., Xi, Y., Lou, Y. H., Wang, Z., Xu, J. Y., Xu, H. J., and Zhang, C. X. (2014). Brown planthopper nudivirus DNA integrated in its host genome. J Virol. 88(10): 5310-5318. PMID: 24574410.

Cunningham, J. P., and Zalucki, M. P. (2014). Understanding heliothine (Lepidoptera: Heliothinae) pests: what is a host plant? J Econ Entomol. 107(3): 881-896, PMID: 25026644.

de Miranda, J. R., and Fries, I. (2008). Venereal and vertical transmission of deformed wing virus in honeybees (*Apis mellifera* L.). J Invertebr Pathol. 98(2): 184-189, PubMed PMID: 18358488.

Ferrelli, M. L., Taibo, C., Fichetti, P., Sciocco-Cap, A., Arneodo, J. D. (2015). Characterization of a new *Helicoverpa armigera* nucleopolyhedrovirus variant causing epizootic on a previously unreported host, *Helicoverpa gelotopoeon* (Lepidoptera: Noctuidae). J Invertebr Pathol. pii: S0022-2011(15)30008-2, PMID: 26296927.

Fitt, G. P. (1989). The ecology of *Heliothis* species in relation to agrosystems. Ann Rev Entomol 34, 17-52

Franz, G., and Robinson, A. S. (2011). Molecular technologies to improve the effectiveness of the sterile insect technique. Genetica 139(1): 1-5, PMID: 21258957.

Gherezghiher, T. B., Ming, X., Villalta, P. W., Campbell, C., and Tretyakova, N. Y. (2013). 1,2,3,4-Diepoxybutane-induced DNA-protein cross-linking in human fibrosarcoma (HT1080) cells. J Proteome Res. 12(5): 2151-2164, PMID: 23506368.

Granados, R. R., Nguyen, T., and Cato, B. (1978). An insect cell line persistently infected with a baculovirus-like particle. Intervirol, 10(5), 309-17.

Hamm, J. J. (1997). Gonad-specific virus of *Helicoverpa zea* does not affect infectivity of nuclear polyhedrosis virus. J. Entomol. Sci. 32(1): 106-109

Hamm, J. J., Carpenter, J. E., and Styer, E. L. (1996). Oviposition day effect on incidence of agonadal progeny of *Helicoverpa zea* (Lepidoptera: Nocutidae) infected with a virus. Ann. Entomol. Soc. Am. 89(2): 266-275

*Helicoverpa armigera* TWG Report, Rev. 1, USDA APHIS PPQ Technical Working Group http://www.statista.com/topics/2062/genetically-modified-crops/

Huang, F., Andow, D. A., and Buschman, L. (2011). Success of the high dose/refuge resistance management strategy after 15 years of Bt crop use in North America. Entomol Exp Appl 140, 1-16.

James, C. (2012). Global status of commercialized biotech/GM crops: 2012. In ISAA Briefs (Ithaca, N.Y.: ISAAA).

Kempf, C., Michel, M. R., Omar, A., Jentsch, P., and Morell, A. (1990). Semliki Forest virus induced cell-cell fusion at neutral extracellular pH. Biosci Rep. 10(4): 363-374, PMID: 2249002.

Knell, R. J., and Webberley, K. M. (2004). Sexually transmitted diseases of insects: distribution, evolution, ecology and host behaviour. Biol Rev Camb Philos Soc. 79(3): 557-581, PMID: 15366763.

Lee, S., Park, K. H., Nam, S. H., Kwak, K. W., and Choi, J. Y. (2015). First report of *Oryctes rhinoceros* nudivirus (Coleoptera: Scarabaeidae) causing severe disease in *Allomyrina dichotoma* in Korea. J Insect Sci. 12: 15, PubMed PMID: 25765317.

Lee, J. C., Chen, H. H., Wei, H. L., and Chao, Y. C. (1993). Superinfection-induced apoptosis and its correlation with the reduction of viral progeny in cells persistently infected with Hz-1 baculovirus. J Virol. 67(12): 6989-94, PMID: 8230422.

Lin, C. L., Lee, J. C., Chen, S. S., Wood, H. A., Li, M. L., Li, C. F., and Chao, Y. C. (1999). Persistent Hz-1 virus infection in insect cells: evidence for insertion of viral DNA into host chromosomes and viral infection in a latent status. J Virol. 73(1): 128-39, PMID: 9847315.

Lupiani, B., Raina, A. K., and Huber, C. (1999). Development and use of a PCR assay for detection of the reproductive virus in wild populations of *Helicoverpa zea* (Lepidoptera: noctuidae). J Invertebr Pathol 73, 107-112.

Luttrell, R. G., and Jackson, R. E. (2012). *Helicoverpa zea* and Bt cotton in the United States. GM Crops & Food: Biotechnol in Agriculture Food Chain, 3(3): 213-227.

Morrison, N. I., Simmons, G. S., Fu, G., O'Connell, S., Walker, A. S., Dafa'alla, T., Walters, M., Claus, J., Tang, G., Jin, L., Marubbi, T., Epton, M. J., Harris, C. L., Staten, R. T., Miller, E., Miller, T. A., and Alphey, L. (2012). Engineered repressible lethality for controlling the pinkbollworm, a lepidopteran pest of cotton. PLoS One 7(12): e50922, PMID: 23226548.

Nguyen, Q., Chan, L. C., Nielsen, L. K., and Reid, S. (2013). Genome scale analysis of differential mRNA expression of *Helicoverpa zea* insect cells infected with a *H. armigera* baculovirus. Virology 444(1-2): 158-170, PMID: 23827436.

Nguyen, Q., Palfreyman, R. W., Chan, L. C., Reid, S., and Nielsen, L. K. (2012). Transcriptome sequencing of and microarray development for a *Helicoverpa zea* cell line to investigate in vitro insect cell-baculovirus interactions. PLoS One. 7(5): e36324, PMID: 22629315.

U.S. Pat. No. 7,476,499: "Methods of identifying anti-viral agents" (use of DEB as mutagen)

U.S. Pat. No. 7,261,886 B2 "Insect larva aerosol infection method for producing recombinant proteins and baculovirus bio-insecticides"

patent #US 2011/0314562 A1 "Insect infection method for production of proteins"

Pichon, A., Bézier, A., Urbach, S., Aury, J. M., Jouan, V., Ravallec, M., Guy, J., Cousserans, F., Thézé, J., Gauthier, J., Demettre, E., Schmieder, S., Wurmser, F., Sibut, V., Poirié, M., Colinet, D., da Silva, C., Couloux, A., Barbe, V., Drezen, J. M., and Volkoff, A. N. (2015). Recurrent DNA virus domestication leading to different parasite virulence strategies. Sci Adv. 1(10): e1501150, PMID: 26702449.

Pushparajan, C., Claus, J. D., Marshall, S. D., and Visnovsky, G. (2013). Characterization of growth and *Oryctes rhinoceros* nudivirus production in attached cultures of the DSIR-HA-1179 coleopteran insect cell line. Cytotechnology. 65(6): 1003-1016, PMID: 23979321.

Raina, A. K., Adams, J. R., Lupiani, B., Lynn, D. E., Kim, W., Burand, J. P., and Dougherty, E. M. (2000). Further characterization of the gonad-specific virus of corn earworm, *Helicoverpa zea*. J Invertebr Pathol 76: 6-12, PMID:10963397.

Raina, A. K., and Lupiani, B. (2006). Acquisition, persistence, and species susceptibility of the Hz-2V virus. J Invertebr Pathol 93: 71-74.

Rallis, C. P., and Burand, J. P. (2002a). Pathology and ultrastructure of Hz-2V infection in the agonadal female corn earworm, *Helicoverpa zea*. J Invertebr Pathol 81: 33-44, PMID:12417211.

Rallis, C. P., and Burand, J. P. (2002b). Pathology and ultrastructure of the insect virus, Hz-2V, infecting agonadal male corn earworms, *Helicoverpa zea*. J Invertebr Pathol 80: 81-89, PMID:12383433.

Reardon, J. T., Liljestrand-Golden, C. A., Dusenbery, R. L., and Smith, P. D. (1987). Molecular Analysis of Diepoxybutane-Induced Mutations at the rosy Locus of *Drosophila melanogaster*. Genetics 115: 323-331, PMID: 17246369.

Simmons, G. S., McKemey, A. R., Morrison, N. I., O'Connell, S., Tabashnik, B. E., Claus, J., Fu, G., Tang, G., Sledge, M., Walker, A. S., Phillips, C. E., Miller, E. D., Rose, R. I., Staten, R. T., Donnelly, C. A., and Alphey, L. (2011). Field performance of a genetically engineered strain of pink bollworm. PLoS One. 6(9): e24110, PMID: 21931649.

Skalsky, R. L., and Cullen, B. R. (2010). Viruses, microRNAs, and host interactions. Annu Rev Microbiol. 64:123-41, PMID: 20477536.

Smith-Pardo, A. (2014). The old world bollworm *Helicoverpa armigera* (Hubner) (Lepidoptera: Noctuidae: Heliothinae) its biology, economic importance and its recent introduction into the western hemisphere. Boletin del museo entomológico 6(1): 18-28.

Tabashnik, B. E., Mota-Sanchez, D., Whalon, M. E., Hollingworth, R. M., and Carrière, Y. (2014). Defining terms for proactive management of resistance to Bt crops and pesticides. J Econ Entomo1107(2): 496-507, PMID: 24772527.

Tabashnik, B. E., Brevault, T., and Carriere, Y. (2013). Insect resistance to Bt crops: lessons from the first billion acres. Nat Biotechnol 31: 510-521, PMID:23752438.

Tabashnik, B. E., Van Rensburg, J. B. J., and Carriere, Y. (2009). Field-evolved insect resistance to Bt crops: evidence versus theory. J Econ Entomol 102: 2011-2025.

Tretyakova, N. Y., Michaelson-Richie, E. D., Gherezghiher, T. B., Kurtz, J., Ming, X., Wickramaratne, S., Campion, M., Kanugula, S., Pegg, A. E., and Campbell, C. (2013). DNA-reactive protein monoepoxides induce cell death and mutagenesis in mammalian cells. Biochemistry 52(18): 3171-3181, PMID: 23566219.

Tyagi, A., Singh, N. K., Gurtler, V., and Karunasagar, I. (2016). Bioinformatics analysis of codon usage patterns and influencing factors in *Penaeus monodon* nudivirus. Arch Virol. 161(2): 459-464, PMID: 26586333.

Unckless, R. L. (2011). A DNA virus of *Drosophila*. PLoS One. 6(10): e26564, PMID: 22053195.

Walters, M., Morrison, N. I., Claus, J., Tang, G., Phillips, C. E., Young, R., Zink, R. T., and Alphey, L. (2012). Field longevity of a fluorescent protein marker in an engineered strain of the pink bollworm, *Pectinophora gossypiella* (Saunders). PLoS One 7(6): e38547, PMID: 22693645.

Wang, Y., Bininda-Emonds, O. R., van Oers, M. M., Vlak, J. M., and Jehle, J. A. (2011). The genome of *Oryctes rhinoceros* nudivirus provides novel insight into the evolution of nucleararthropod-specific large circular double-stranded DNA viruses. Virus Genes 42(3): 444-456, PMID: 21380757.

Wang, Y., and Jehle, J. A. (2009). Nudiviruses and other large, double-stranded circular DNA viruses of invertebrates: new insights on an old topic. J Invertebr Pathol. 101(3): 187-193, PMID: 19460388.

Wang, Y., Kleespies, R. G., Ramle, M. B., and Jehle, J. A. (2008). Sequencing of the large dsDNA genome of *Oryctes rhinoceros* nudivirus using multiple displacement amplification of nanogram amounts of virus DNA. J Virol Methods. 152(1-2): 106-108, PMID: 18598718.

Wang, Y., Kleespies, R. G., Huger, A. M., and Jehle, J. A. (2007). The genome of *Gryllus bimaculatus* nudivirus indicates an ancient diversification of baculovirus-related nonoccluded nudiviruses of insects. J Virol. 81(10): 5395-5406, PMID: 17360757.

Wang, Y., van Oers, M. M., Crawford, A. M., Vlak, J. M., and Jehle, J. A. (2007). Genomic analysis of *Oryctes rhinoceros* virus reveals genetic relatedness to *Heliothis zea* virus 1. Arch Virol. 152(3): 519-531, PMID: 17106621.

Wijen, J. P., Nivard, M. J., and Vogel, E. W. (2001). Genetic damage by bifunctional agents in repair-active pre-meiotic stages of *Drosophila* males. Mutat Res 478: 107-117, PMID: 11406175.

Wood, H. A., and Burand, J. P. (1986). Persistent and productive infections with the Hz-1 baculovirus. Current topics in microbiology and immunology 131: 119-133, PMID: 3816297.

Wu, Y. L., Wu, C. P., Lee, S. T., Tang, H., Chang, C. H., Chen, H. H., and Chao, Y. C. (2010). The early gene hhil reactivates *Heliothis zea* nudivirus 1 in latently infected cells. Journal of virology 84: 1057-1065, PMID: 19889784.

Wu, Y. L., Wu, C. P., Liu, C. Y., Hsu, P. W., Wu, E. C., and Chao, Y. C.

(2011a). A non-coding RNA of insect HzNV-1 virus establishes latent viral infection through microRNA. Scientific reports 1: 60, PMID: 22355579.

Wu, Y. L., Wu, C. P., Liu, C. Y., Lee, S. T., Lee, H. P., and Chao, Y. C. (2011b). *Heliothis zea* nudivirus 1 gene hhil induces apoptosis which is blocked by the Hz-iap2 gene and a noncoding gene, pag1. Journal of virology 85: 6856-6866, PMID: 21543471.

Wu, Y. L., Liu, C. Y., Wu, C. P., Wang, C. H., Lee, S. T., and Chao, Y. C. (2008). Cooperation of iel and p35 genes in the activation of baculovirus AcMNPV and HzNV-1 promoters. Virus Res. 135(2): 247-254, PMID: 18486255.

www.usda.gov/nass/PUBS/TODAYRPT/acrg0615.pdf (USDA "Acreage" 2015 ISSN: 1949-1522)

Yang, Y. T., Lee, D. Y., Wang, Y., Hu, J. M., Li, W. H., Leu, J. H., Chang, G. D., Ke, H. M., Kang, S. T., Lin, S. S., Kou, G. H., and Lo, C. F. (2014). The genome and occlusion bodies of marine *Penaeus monodon* nudivirus (PmNV, also known as MBV and PemoNPV) suggest that it should be assigned to a new nudivirus genus that is distinct from the terrestrial nudiviruses. BMC Genomics 15: 628, PMID: 25063321.

Yazaki, K., Mizuno, A., Sano, T., Fujii, H., and Miura, K. (1986). A new method for extractingcircular and supercoiled genome segments from cytoplasmic polyhedrosis virus. J Virol Methods 14(3-4): 275-283, PMID: 3539959.

Zhao, X.-C., Dong, J.-F., Tang, Q.-B., Yan, Y.-H., Gelbic, I., Van Loon, J. J. A., and Wang, C.-Z. (2005). Hybridization between *Helicoverpa armigera* and *Helicoverpa assulta* (Lepidoptera: Noctuidae): development and morphological characterization of $F_1$ hybrids. Bulletin of Entomol Research 95: 409-416.

All percentages and ratios are calculated by weight unless otherwise indicated.

All percentages and ratios are calculated based on the total composition unless otherwise indicated.

It should be understood that every maximum numerical limitation given throughout this specification includes every lower numerical limitation, as if such lower numerical limitations were expressly written herein. Every minimum numerical limitation given throughout this specification will include every higher numerical limitation, as if such higher numerical limitations were expressly written herein. Every numerical range given throughout this specification will include every narrower numerical range that falls within such broader numerical range, as if such narrower numerical ranges were all expressly written herein.

The dimensions and values disclosed herein are not to be understood as being strictly limited to the exact numerical values recited. Instead, unless otherwise specified, each such dimension is intended to mean both the recited value and a functionally equivalent range surrounding that value. For example, a dimension disclosed as "20 mm" is intended to mean "about 20 mm."

Every document cited herein, including any cross referenced or related patent or application, is hereby incorporated herein by reference in its entirety unless expressly excluded or otherwise limited. The citation of any document is not an admission that it is prior art with respect to any invention disclosed or claimed herein or that it alone, or in any combination with any other reference or references, teaches, suggests or discloses any such invention. Further, to the extent that any meaning or definition of a term in this document conflicts with any meaning or definition of the same term in a document incorporated by reference, the meaning or definition assigned to that term in this document shall govern.

While particular embodiments of the present invention have been illustrated and described, it would be obvious to those skilled in the art that various other changes and modifications can be made without departing from the spirit and scope of the invention. It is therefore intended to cover in the appended claims all such changes and modifications that are within the scope of this invention.

SEQUENCE LISTING (19 sequences)

SEQ ID NO: 1 - DNA, 231621 bp, Helicoverpa zea nudivirus 2
gtgctctaaaatgtcaatttgcatctcaaagactgcaaacttgtatgccttaaaatggtgccattaccgtgtctagttttgtactttgggctttacttttgggctttactttagacgttaagatactcgatttagatactattcttgtcacaagtgaaaccaatgtcacaagtgaatgtcaaactaatatcacaagtgaatatcacaagtgaaactaatgtcacaagtgaatatcaaactaatatcacaagtgaaactaatgtcacaagtgaatgtcacaagtgtacagtacaaatgtattagtgttaggattgaaccaagtatggttatttagaagtaagatgtaagtagtgtgtagtaggtagtaagtggtaagtaacaagtagtagtatgtagtagtacgctagttgtttagtattctagttgtttagtattctagttggccagtatgctagttagattcaactattgatttagtttaaattataatgttactgttgaagaggtagtgtttaagagttctgttgaagagttattgtttaagaattactgttgaagtagagttactattgaaagttactattgaagtagatttaagaattgtgtgccacctatgaaaaagactatacttgcccatctattttatacatgtattttagagtatttttagagtatttttagagtatttttagagtattttagagtcaagtttatattagtattttaaagttaactatatttagatttaaatacctagtagagttatatacaaatgtcaaatatcaacaagatgaaatatcaacaagataataaaaagtgtttacaacaatcaatcagacttgtatcatttaaagtatccaatcattgtatccaatcattgtatccaatcattcaagcaacccattaccagattgcctcccagactaccattcacttggctaaagtgtcaattgccgtctttcattgaactcgcacatattgccataataatactacctacccactttaatccctctctcactctaaggtcaaacctcaggcaaattgctcaggtctcagatctcagtctcagttctcgggttttgtttagagttgtatagttggcagttgcctttgtttataatttacatcgttgtttataccaagtctcgccatacacacacttttcataggtactcttcacaagtacttctcagtactagttgggcactctccatagaggaagtgtgtgtatattgtttatatgatagtttatacgatagtttgtttatatgctagtttgtttatatgatggttgactggtggcgataccactggtggtgataccaaatgaatttattatataaacattgtgtgtcatcaaaacagtgtgactgccatctttaggtagtgtatcaatctctatgttgactgtgtacttgaactgtacttggttgtatgcattgaatcggtatagggctgtattgaatctgtaggtatagggttatattgaatctgcatagcgagactctttgctagcacgactcctagcactaatctctccatctctctacacccagtagtcttacatattactaccatctaatgataccatcatctaatagtactacaatccaatggtaacatacatcccatctaatggtgccaccatctaatggtagcctacatccctaactaggcaaatcatgatttgtttgacatcatgattttagagtgaaggcactctggcaaaaaatgtaaacaaacacagcaaggatcaaggtttataggaatcagtaaaataccaaggatacagtttacacatgcatttattgaggtttatttataggggtttattatacagtgtacatttatggtttgaaataaaatgtaaaacatgattaaaattacacttgtaaaataacgggtatatttagtataaatggaatggtatacaagagtgtgtctttaataataagtgtctttaataaaaggtttagtttatctaaatatagattctttattacatctaaatacaaggtttaaccataatgtctaaatataaagtctaaatataatggctctatataattcctctataatctacatatttcctctatacaaagaatacaaaagtacaaaaaaaagagtattaaaatagtaggtaggtaggtaggtaatataaaagagtacaaaaatacaaaaggttacaaaaatataaaaagagtacaaaatacaagagtacaaaaagaacaactaaatagaaccaaagttcctccaaacataaaacataaatcaaaaaaacaataatctactcatgtatacaacgagtcaaacatggcgtggtaaaggttgaccgtgtcggtcatctttacaccaatcatgctcttgaaatctttggccattaaagttttacgacccgagtttaacattacaatataggccgcctccaataaccgagccagatagcactcggtcacgtctcgcatcaacaacagagcctggcccctgtatcggagatgcacaacttggtaagagtcgatctgaatttcgatattcttccaggcacgacaaaaaggcaaagtcggtatgaattgcattttacacgatttggacttgatcaatttaatcatgtatgccacatcaaacttttcatcttttgcactgccaggatccctaccctcgtaatcgtaatcgtctgccaatacacgcaaacctacagactttagaatagatttaatgtcacgaatctctacagtcttgcgcttaccgcactctaccaacagagtcacacgacgcttgacctccttcatgaaaaactctatgattctactcagctctggatagacatcctttgagattctatctatacccaatcgttcagcaaaacgtctaataatgttcttgtttataaagttgatactttgagactttttaagacgctctgcacgcatggcggcaattctactaccgccaccggcttcactagagattttatgaatacgcggcaccttggtggcaatgggtagagttctaactgtgggcacattggcgggagcctttacaaaaaggtatttgcgctgttgttccctcttgtcaattttggacttggcggcctcatcggtggatggggatttgtatggagaggcaggggttttgggagctggggattcgggtacagagtttgagttgttggtattgggtgtagatggttcagtgtttgttgtaggtgtagatggttcagtgttggattcagaggttgatggtgcaggactatttgttataggtgtagatggttcaatgtttgttataggtgtggatggttcaatgtttgttgtaggtgtaggtgtaggtgcagatgactcagtgttgggttcaacggttgatggagcagggcttgatgtaaatgtagagggagttgctttaggcttggaactgggtttgggtttgggtgcagagtttgctttagctttagacttggctgcatcagttttaggtttaggtttgggatcagatttagacttggaaacgttttcggttgtttcagtgtccgagtcttgatcgtcagaaatgaactctttggacttgtattgcttggaacgtttggatttagaattggatatggtcttgtacggcaatggaagggttggtatagggataccgttagagtctactctaggagtggtgggttgtttaaaaataatggtaacattttgatttggagtgttggttggaggtttggatttcgggttgggtttcggtttgggtttgggttttgcagcagattgtttaggagcaataggtttaggaatagtagtagtttgtttaggaacactagttggttgtttaggatcaggtttaggagacttgggtgcaggcttggtgttttcaacagaagaagcaacaacagtagagttggactttgtcgttttgggattggatgcctcctttgcattggatgactcttcatcctcagagtccgagctaccactactatcattgtcgctactaccactatcctcgctaccactactctcttcatcgctgctgtccgaatccgactctggtgccggtgatttggattgagtggtgttaatctgtttacgagcaatcagtggtttaggggcaatctcagagtttgattcggacgcattgggtgggttagagtttacactagcacctacatttcctacagaatccttctcaacctctttgtgcaaattttccattgagcgttctacatcagagccaatgtttgacaagttgattggtacattggacatggatgtattagatgatgcattcgatgctgcatattcttttgttgcagcatttacattgttgttggactctactacactagttgcatttacattgacagttgttatagattccaccgaaccgtttacatcgtcaatctccatagcagcgttggacgcgatcgattctacacccgagtcaaattgcgcattagactctacgctattggccgcagtgtcgtaagtctgatagcccttgtttgcagtgtgatcaaacttgacatactttttgtgtctgtattcagatggtttattttgaataatgggtttgatcacagtcgcatcctgagctgcagacttggcctgatctactaccggtttaactgtaacaatgttgttgtgtgcgtttaatggacgagtgttaaaagatgaaacactaccgctactagcagtggtagcagttgcgctagcgctactagtattggcaatggtgaatgtattacctgccgactctgctgcggtagtagagcgcgtaaccatagtcttgatgccggccgaaccactacgtaacactttaccgccgccgatattctccttttcatgtgtacgtttacgactctgcattttggacacgtcaacgatctcgtattgagtgtttaataaaccaatttctagttctgtgttgccttgacctgaatttataacctctttgcgcgggaactcgacacgtactgaatttagcgcctctcccttctcctgcgcacgcgggcgtttacctactacagtagtcatgacactattgtcgtctaatatggaagtgtacgtagtcttgttgttattgttattattattataattgctgtaatctacacattggtcctcgtcatcggtttcgataccgctacgtttaggagtgccgtccgcgtttatacgtttgccgatagatggagccgccctaggggtatctttaaagtttaaaaaggtcctcataaatttaagcttgtcctcttcgagttccattgcatgttgcatgtcgggagtcggagtgtttagcgtgtctctataaacaaaagatgatggattgtttgacatctctgcttgattgttattggcaacatcaaacacgggaatttcaaagcccaagtcatgcatcgtaatgttgggagcagcagtattgccgagttcatgagccatgttagtattggtggttggaatgggaaagattgtagtaccaggaaagatggttgcggtgtcgggcatcattggattgaaattgtacccatagccgttgggataagtgtttggatacatcaagttgttgtatacaaactcgggttgttgatagtactggggattagttttagaacggggacttttaccggtaggattcatgcttacaagcttctacttatacttctacttctactaacaccagttgttacaattacagtacactaagagtaaataaataataagagtaaatttacaattgcagtacactaagagtaaatgaaaagagtacacaaggataaatgaataaagagtaaagtaaagtagtaaagtaatacaataataaaatagagttaaataacaagagtaaatgggatgcaactaaaactacaattcaaactataatgcaagtcctaaaatacaataacatgcaaagtaaaactaaaatgcaaagtaaaactaggatgcaaagtaaatataaaatgcaaaccaactctaactctatactacaaaaacactagtctagtatacagcagccgcagtggagtcccttgtagcagcagtagatgcactagatgcagagtgcaaaaacaccagtatacgccactagcaaactacaccagcaaacactataccagcatacaccacaccaacacagcaggcagagtttagagatgtgtaattttaaagtcacctggttactttactggtaaaagtgcacaccagagcaagagtcgctcagagcaaccggtagagtagcaccacagtgcagtgtagaacagggcaggagcaagtctcgagctcgagcacaagacaatgtgcgagctcagagagagatatgtgttcaaagagagaacaccaccacacaacgccacaacgccacaaaacacacacacaagtctttggtagagtctttggtatttttttagagtacaagtctttggtaaatatatatttgatataaatgacaagtctttggtaaatatatttggtatcgggtattcagagcctaaaagacttctgaacaattacaaatccagcaaccggaatgcaattaaaacacttgtgttttgtaagcaaaactcaaatccaaaatttaattctggaattgtaggtttacgtacacactggaatataatttgcattaattcgggcaaaatctagccgtctagccgggatctaggagctgaatataggtcaggataggttttttgcttttatatggcctagattccaactttggaggggtgaattaatagggatttaatagtcgagtcgttttgtatatacatatatagaaaattgtatttaacaggccattaattgaactttaacagcaatttaacattaatttaacagcaattttaatatgttccagatacctaccgtacgcccactgaaaattcttcatataaatacgataatggtaggtgttggctacataatagctttagccaccctgctgtacgtacattttcctgtttattcagtcagtgtacggactctgtgcggataaatactgttattctccgagttttggagtttttattctgaaattccaactcggtaaaaatcacaagtctgtgctacaactctagtacaagtgctaaactctgatactagtgattggctccaacactagtgaccaaactttaccaagtgattgactctgatactagtgatttacacaagtgttcaactctcctctacaatcatgtctaccggtgctcttggactggacatgaccaaagagtggtcgtgcctgtatggtacgtacgtgtttcgctacaatggcgatggtcgtcagcgaggcaatgtgctcgtcaagtacactgccattgccgtgactccgggcaacatcaagagacttcgcacttgcgacattaccaaacgtgtcgtgatccgagaacccaagccgctggagcacatcaaggagatgctgcccgagtttcgtggtctgcgctgcgaagactctcaggagaaggtgattttgaaggaactcttttcggtgtctgtaatatttggatgtttaaactttttgattgacttgcatcaaaaggtacgagaggatcaatccaccatggtcatcaaagagtacgagattactgtagatttaaagtgtctgctcaaaagcaaattgttgaactgtctaactctgctcggggacgggtacgctcccattagaatcattcagtcctttaacgagacctttttcgatatgaacattaacgatgacgatcacaacaattggcgtttgagcagagagtatgtatgcgctaggaacctgcgtgaaaagatctctaccgactcgacctttctgaactttgccaacattagcagtgccaatatgatgctcttgtggaacgagatgcaggccgacattcagtctaccaccaagcagccagcaaagagtgccgagtccattttgcatccgtttgttcagccccagatgcagcagccgccgccgtcggtggttagttcgtattttgtaaacacttgtaccaacattgctgccaatgctggcactggttcaggagggagtgtcggtggttctagtgattgctctaaggatgctaatgctagtactagtggtgtcagttctagcaaagctgttgataatgtaaactctagtgttgacaactctagtgttaatactggtgtaagctctagttctgatgcgagttctgatgcaagttccaaggtaagcaacagttctggttccaaccgttctggttccaacaatggttctggtaaaaacacttctggtaaaaatagcaacagcggctatacacctagcgactacaagtacgattgcggtagagacataagggttggcgaggacgaagaggacagcgacgatgaggtaatgtccatttcatccgctcggtctagggctagggttataatgagtagtagcagcagtagtagtagcagcgactctgaatccgactacgactctgactctgacattgaactcgtttcatctggtcccataccgcaaccgtttggctctaaaagttccaagtttaaatccaactccaagtacagtgccagttttaaaaccaaatccaagagctcttctaagctacccaaacattctagctctaagagctcctcttccagtaagcattcatccaagtctgactctaaacattcaagctctaagctttcaagcaactccacgcatgcctccaactctaagcattcctccaactctaagcattcctctaaacatcactcgtctagttccaagtctaaatctgctgcttccaagcctgtagcaaaggttactcctacagccaagcctgccgaggccaactctgcttctaaaactgcatctaagcctgtatccaaacctacaccaaagcctgtttccaaacctacaccaaagcctgcttcaacttcaaatcctacacccaaacctgcttctaatcctacacccaagcctgcttctaatcctacatccaaacctgcttctaagcccgagtctgtttctaaacaaccaacaccatccaaacctacttcatccaaacctgcaccaaaacctgcttctaagcccgagtctgtttcaaaacaaccaacttcatccaagcctacatccaagcctacttcaacactaaccaaacctacatccaagcctacttcaacactaaccaaacctacacccaagcctactaaacccgattctgtttctaaacaaccaacatcatccaagccctctgaaaagccatcagacaagactactaatactactaccactactaacactactaacactacacctgtttctaaaccaactttatccaaacctacaccaccaacaacatcatcatccaagcctactccatcatctaactcaacctctaactcaacctctaactcaacctctaactcaacctctaaatctacatcaaaaccaacctctaatacatctaaatctacatctaaacctacatctaaacctacatccaaacctacatcaaaatccaacacttcaactgcctcaacctcaacctcaacctcaacctcatcctcatcctcatctaaccgattaacacccgcccaaatcctagatatgattttaagccactatctaaacggagacattgactctctgcgcaataggccaccaagacctcccattagcgaagccgaagcggccattgctcagccggtgagtgcctttgccgaatgcgataccaataatcctgatgtggtagttcaatctaaaacattccaagccaagactttccaagccgcagaggtttccattgacgaggacttgttctatgttaggccaactcttgacatggtagaagtgtttgactcagactcggacattgaagctcgtgcatctcaacaagaggccactttggcagtttccaatgaggctccatctgctctcaattctgaaccatcctctaatgtaaatgtaaacaattcaactagtgtagaggagccctctactaatgcctcttgtgcaactgacgaacccgtaactgaatgctgcatgtgttgttcttgttacgataatgtagaggactcggagcttacagtagagactccatccgagtctacatctaatgtaaatgctgagtcggcatctaatgtaaatgagccacagccacagcaaactgagccagtggcaaccgagccagtggcaaccgagcccatggacattgagactgcttacatttccgactctgagtacgaatctgatgttccaactgtagagaccgagactaatgactatacaaatgtagagattactgaaccgacaaatgtagagattgatgaaccgacaaatgtagaggagaatgttgaacctgagagtactgaacctacaaacgtagagacttgcactccaacatcatccaaacccaaacccactcctgaacaagtagaggcaaacattgcattattggaagagttgtttggtgcaacctacgagagacctgatactaacgatgctaacaataccaacaataccaacaacactaacaatactaacagtgccaatattgacattgatcccgaactggcagaccttctcgacccaaacaatgaagagaatcgagccaacgattccccgaccaactatgacaagtatttcaactatgacggttacgattcagacttttcagaggtcaccgatgatgcttattacgattccgacgactctatagaactgcctcccgaaaagggggccaactggaaggtcaccaagactagcgacgcaaattacaatgagattagggtaaagcgtacgatgaagtgttccgaaccgaatcgcaactctaccaaactgctcgaagtctccacaatgattgtggacggtgtacgtatcgatagggttaaacaggttttgcatgagattaacgaaaacgatgaacgttctctggtacgcgttgatgatggtgtagaagagtcggactctgacgaacaacagccgactgttgaaattaccgagttggaggatgaggatgatgattctcaacatacagttaggatagagccggcttcaccggtcatagacatggcatctcctgacacggccgatatttcatgggaggacgagttgtacatttctgacgagggagaggagggtgactgtgatggttctaaaccatcaacatccaaaccctctaaaccatctagccctagcaagctttccaatgaatctaccagtaaacctaaaactgttcaaactaaaatcactcaattcaccattgactttgaactggaaaagtccaactcgtcctctgtcccatctgacgatgtcgataaagccagaaagattctatctgacagtgagtttgattctgaagttgaacatttcaatgacaagcaaaaggctcagagcgtttctagcgacagtgttgtagatgtaacaatggacaatttgcagtccatcgagttgagcgatgatgaggatgttcaaattcaaacaacaacaaccccatcaccgctcaagcgtcgtagatccaaagattttgacatggacacagagttgaccacttttgtagacagttgtgtcgattcgaatgaaatgttcaagcctgtgcccttgtatccagatggtagtccaaagaggcctagattggatgatggtgttggtaataatgttggtagtaatattgatagtaatgttagtgagcgtgttgatgaggaaaatgttactacaagtgttgttgagagtaatgaaaatgagaagcatgttagcgagatggatacggtcgagtatgaatctgaatctgagaatgaggatgaggatgaggatgaggatgaggatgaacctatgcgtgaaacagagtgtgaaccagagtgtgaatctgagaatgaggctgaggatgaacttatgcgtgaacctgaacgtgaacctgaacgtgaatctgagaatgaggctgaggatgaatctgagagtgcctctgaacatgaatctaatcgtgaatctgagagtgaatctgagcgtgaatatgaatcggatgatgagggttccgaggacgaacgcgtagagcgtaacggttccaagtttgtagaatcggaatgtgttgaagatggctctgaacccgaatccgagtgtgaatgtgaatatcctgaatctgagcatgaggatgaatctcaacatgaggatgaggatgaatctcaacatgaggatgaatcggaacacgaatctcaacatgagaatacatctgattgtgagaatgaacctgaacatgagaatgcatctgatggtgagaatgaatcggaacatgagaatgcatctgagcgtgagaatgagaatgaatctgaacacgaggatatgtacgaggctgaaactgagccagaacaagaaccagaacccgagtcggtaccagaacagtttgtaccagaacagtcaatcccagaacagtctaccccaaacctagaacaaccaacatccactgtaaaatcaaacatcgagtctagtgtatcgtacaagcgttttctagagcgtatggactcgtctaatctcaactctcaaaagaactggagtagttattttgatgatacagtggaacagcgtgcgtccacttcaacacccaaaaagtccaagtctaaaaaacaaaagcgcatcaatgtcaccaagactagggtcgcggtaaaagagttggccaaatccaacaattggtccaagttgaaaaagctggtaaaagagtttaaagccatcgaggctaggcttgctgacattgatgactcggacgaggtgctcttgtgcaaactggagcgtaggcgcgaacgtatacttagaaaattcaaatcaaccagcggtgtcagcatcagggtgggtagtctgttggaaaagctaactatgaatctacccagacacttggtcgattaccgagaggccctagaggcgtgcatcctcaacaatagtcgtaaatcgttaaagttgccaactgtcgagactgtaaagcgtgccctgtgtttgtcacaaaacgatgcagttgaactgctcaagtgttgtatagagtcgttgcaaaagattaacggtagggatgaggatgatgatgatgatgttgacgaggccgatgaggatgctgatgttgaggatgagttgtagtttaagtgttagttgtaagaaagatttgtaatgtatatagttgtaagaaataattgcaatgtatatagttgtaagaaatgattgcaatgtatatagttgtaagaaataattgcaagaattgtaagaacaaatattgaacaaatgtagttttaaggattgtttattgatcagttatacattaaatgtaaactctaaactgtggtgttttataaactgtgttattatattattacattattttacattatttgttattatatcattatatcattttatgttattctatgaaaataaatattagttgaactaccaacttgtgatttcatttatacattgatttctacattcattcatacccttcattcataccctttatttataccaaagttgtacacaagttagggaacctagctaaaccaaagtcggaggctcatacaaattagggaaactagctaaaccaaagtcggaggctctatacatgcaaacataccctaccctctgtaggagagcaccaactctgtgtaaacacactgagctcaaaatgtgccacttttgcatatacacccagtgtatactttattgaaaattacaaatttattttcaatgaatcaaccctgtaataagacatgttgcttgttaagcgcagtgtgcatcccctatacgtcatgtcaaatttggtacttttgaatcgtccagtgtcagtcgagaacggtgcaatcaacgccaacgaactggcagaggttctgggcttcgatcgacacttgatggtcgaacacgtagacgatgcctaccaaaacttgaaagatgacgaaaccgacactctgtacattacacgcactggatttctacagatcctggctgcaatgcaccacactaccaagcactctgacctggcccgtcgtctgaccgaatccaaagaggttctctcctggatgggcttcactcgtaaacagatggagtgcactctgaacgtgcacaagattaattatcgcagccgactaacgttcggtgccatggctcgattctgtagactggtcaaccagggctttgcctatgcctacctgtgctaccctaaagacttgtgcctctttgacagtcccgagagacgcatcatcgacaagcccatcaagtatagcgtgcccaaagaggacgacgctctgatcatgatcgacaacctaaaggtggcagtgtttctgcaaccgtttacacagctcgaactgcaagagtacagagccatagccgaggcaaagggctacactctgatgacgctaaccatacgaggtccggccaagttgttgggggttttgatttacaagttgctaaatgtgtagaatgggagagagctgtagagaggtagagtggatatagatatacacatgacctaaaggttcatcacaaagagtgccatattagatgttagctgttagattagttagttgcaaaatattttaatcatttacaaatggttatatttaaacaacactattttgagcaagtgttgtattctattgtattgaactggaatgaaatgaactgaaagaaattgaatctgtgttacatctatttttattttttagcatcaatgtagccattgttgtattattacattgtcacttgctacttgttattttcacttgctacttgttattgtcacttgatacttgttattatcacttgatactatacacccactttaaagactcgtagcacgtgtacaatattctaaattcagagtataatattacaaaattcagagtatagtattctaaaattcagagtatagtgttccaaaattcagagtatagtgttccaaaattcaaactatactattccaaaattcaaagcagaatatcacaaaatttaaagtacagtatcacaaaatttaaaacactgatttaagtatgccatcacaaaatacagaattcaacattacaaaattcagagtacaatatcgcaaaatgcaaaactgagcatctcaaaattcaatgcaaaattcgaggttttaatgttgtaaattggattatgaaatatctcaaattttaagccattaaaccgcagtctgtatattgactataaatcatcatgaaattcaatctggagtttcacaaaattcaatctatacggtcgtaaacgagagtttttggtactaaaaatgcctgtgccggttcaagtaaaaatacagaatcaaaggtctagaagttgactcgtgtaaaattgaatccgttcaatttccactcgggtgttggaaacgtgattgctttgctgctgcgtaaccgatacacacattacaagaacaattctagattgtgtaaattacctctggcttcatcgaatgccaagacactttttgatttacaagagtaggttgatttacaagagtaggttgatttccaagagtaggtaggttgatttacaagagtaggtagtgttgggaataaaagacatttgaatatataggaactttgtttatttcaagtttagtacaaatcacattggtcacatctagctgtatgtttgcatactctttaatatttacaaaatctcttacaagtctatttcatccttacatgtctatcacatctactatatacaatcatatatatgtatatacactcttatacactaatatatacagtacaatttacaagtcaaaatatacaacatacaacactaaaaaactaaaactaccaccaactctaccgtcaactccaacgtcaactccaactttaacctcagtctcaatccacaactatacacgcacacgatctctctatctctaaacatcaaagtttaaaccaacaccataataggtctccacctccaccgagtgatgcactttaatccgcttgatggtaccctcttggtgctcctttatgtggcgtttgcgacacttttccaagtacgacaccagctcgggttgcttgaccaaacgattccggacaaagtgtctgggcttcatttcagtgtacaactggccagagaaacgaaacgccaactttcccaagattacatactcgggcaccttgtagtctaccaggctcgacttgagcggtgtctcccaccgatccatcaggtcaaagtaggtcctacgaggcacgctgtacatgtactccaactgagtgcactcgtcgaacgtgtacagacaccgaatgttgctgcgcacattcataccaatctggtagagtttgtgcaacaggtaatggaacacttcagccttgcgcagttcagcaaacatgcactcgccgctacggatcgaagccaggcccgattcgatgcacggacagccaacgtagtcgaccagccggtccatttcgcgctgatcgtactcggacggcaccagaatgaacccgctgccgatgtagtctcgagagtcgcaaaagttgtgcatcatggtggcatacctccaacccttgggcagagtttgtaccgccttgatgtcttcgaccaccggtttgggcaattgctccaaagacttggccgaactgagtttggcactcttgatgacgcgcagaatggccaactggtagagggatggagggcacatggttgggggctactaggatgatgctagacctttgatgataattactagaccagtgctgctccgagggttgcagtacacagaatgatgagcttatctgcaattgcaagtttatatactccaaccaccggatgttgaaaacgtgtccgtttaaaaaataccatgattcacaaaacagtcatgcataggaaaaagctttacagctacctataaagtgagtatgcaattatggataatacgctattggtggtataagaagcacgactattgtagaatacactctggtgtgcgcgcatttctaaacattcaaacatgctactattcagaggcatttcctagacacttgaaagttggggctttgcatttccgagttgttcttagttttttagactgattcaacctcctactctttaggtgctaggggttctagttttttagaagactagtgattctagttttttagactcggtatttggcaaatgttgtagctctgtgcattcaagtactggtagttttgggatgcttagaatcaaataaaactaaaaagttcgtgcattcatttattatatagatggaagaacaatacaaattcaaacagtaattcaacattcacaatagtggagcatcctaacgggttctactctatcctatctgttctactctatcctatccattctactttatccattctaacctatccattctactctgatctagtccattttacatacactacaactctccaagcaacacctccatcaaaccattctaacaatgagtctcttgcgaaagccaacatcagagaccgagtttgatttggaagatttaaccattagtctttcagactaccctttgagcaatcacagcatagtcgatgatattcaacacttgatgggcgacctctactaccagtgcaacgactcgacgtgccgatgcaagattgaaataattgtcggcttcctgatgggcttcatactgggaagcgtactggccagattgacatctggctatgctgcaaatgcacaccactctcgacaagatcaaacagatgacgagggcttgggtacgagcaccgaagagggtgagaatgcggatgatgacgacgatgactacagtagtagtagcgaagaggccaccgactatggtgccagtaccgatgaggatgacgatgacgaagatgcctcggaatggggcaacgaggtgtgtttggattaagtagtgcaaaacaggggccactgtattgcacgacaaacatactgaccatgctagtagaacccaaaccagaatcggaggctacccgtaccaaagtctttaattcaaaacaatctacaacaatctacaacaatctaaaacaatctaatacaacaatcaacaacaacgctactacaaaacctcttgagaaaaatcaacctctgattttgaatcctacctccagaccacactatacaaaccaatctttaaatcaagagccataaacaaagcctacaatcagagccatagactgcaatcaaggcctgtagtaaaatcctcacaaaacgtataatcaaatcacaaagcctacaatcaaaacacaacgtctacaatcaaagtacaactcctacaatcaaattacaaagcctacaatcaaatcacaccaaacgaatcaaaaactgaatgcacgaaaagtatatgtgtacaatatatgctttggtgcaattatattactatgctactatgctactactacaagctgcaataaaagggtgccatagagtgtatagtttacaaaagtctagagagatatacacagagactggtgttagtaggaaaggaaaaatacaagtgcagtgtgcatttttaggtgtattgtaaaactgtctaaaacatatgtgtgtgtagttgctaaatgtaaatactagatgtaagaatacatgcgagtgccctagatgtaagatgctttagatgtaagatattctagatgtaagatgtcctaaatgtaaaataccttagatgtaagatgtaagtttacaattccaagtagatacctaataaaaactttacaaaatataaaatcttgttttttaaacacaaacaaatacaacacatgtaaacatgaatgttaaagaataaccatgaatgtcaaagaatacacatacacattaaaaacagtttaactaaatacattaaaaaatgcatccactctgcatctacataaaaacacggcaaacataaagataagactgatgcatcaatcaaacaagtttagtggcataatacatgataaactgtagacagggttcaaaccactctctctctctataatatttctctcatctaatcctcgacgataatagttttattacccgacattagacgcggtatacagataaacttggcagtatcgcagcccttgtgtttgtggtgtctgcgagttctagccagaggtttgacctcttccgtcatcgtagtagtgtttgcagtgtctccattgggcttgctgacaacggtggatgtagtgtttttgtgcagagttgtagggtcgtctttgtgctcgtcgtggtcgtcgattatggtggtcgtggtgttggtgcacggcttggcaaatagatgatggtgcaacaggtgacgcttgtttcgatgtgcctgtgaaaaaagacgagcacctcgttatatgctgatacaaactagggccactacaaacttgcacactaaaacaaacaagagtgcagaaaaggtgcataggatcataatcattattattgtaaggctactcagcgtttgctcttgctgatctataatgtactgttcgaccggattcggagagtgcactgccgtttgattctttatggtgggttttaatgggaatattggaatgaggctagtggtaccgttattaggttttctgatgggttttaaaaatatactcgtagggagagttggtttgtgtgtagtagagggaagcgttggtttatgtgtactataggaaagagttgcattatgtgtactagagggcctagttggtttgttggatagtgtaggtaatgtagcagtagtagtaaaatcatcacgtgtattagtaaaatcatcacgtgtattagtaaaagtatcacgtatagtagtattaaaaacatcatgtaaagtagtagccacctctggtacactagacaccaacagctctggtaaaggttcaaactgtggtacacctctttgcactgatgctacatcaacacttggctcgtcagattgtaacagagtcagagggttaaatttaaactttagcgttcccgattcaacatttggtagagcgtagccattaataatacttccaacgccgaccgatttagcatcgataaagtactcggaaatggacacattaaaaccgccaacagtggtcattattgaaacaaagggtactgtttcatttgtcgcaacaggaactcgttccagtgtaaagcgactgttgttataataatgaaaatgtttacattcggggtcaagagagctatcgggacattgttgattctcggaacgcttgaacagaaacgtttcagtgtttgatacgataagctcttgctgatgctttacagtactggctttgttgttgttccaagtgtttagatagtgtatcaacaatggcaccaccacctctgaatgcgtataattgagaatgctacgcttgctatccaaacgccaattgtacagattgctccagtagccgtccagtgtgtcgaatcgactatcgttgccgttgaaggcaatcagcaccggtaccgtggtggccggaaagggtacattgaaaaagtcaaaatccaacgcatctcgagcattgagaatgcacacggaaaagggcaagtttcggctgaggttgccctgtacaccggacgcgtccaactggaccagtacactggcatcggaggtttggccgtgtagattcagagttgccgtctcggctcggtgcacggtacgcaccagtactctggcgtcgagacgtttcaacttgagcagcaaccgacgctcgatgcgtttactggccacggttgaattggtcaagtttaagcgcttggcaaactccaagacacgggcactcctaatgaccgaatcggtacacactgcctgttcgtttatggccgacaccgagtctgttttgtagggcagcgaagagtcggtgttgtacaagagcggcgagtcaaacattgtgactgtgcgcaccatcagacccttccaggcaagaatgtgcacaatgactgcaccgtatccgtagcccagtaggtttatcgattccgagtcaccgttgaatgcggcaatgttcctcttgacccactgtacggccagacgcacatcgtgcacgcccacattgctaggtgccaaatctcggtcaatgcacagaaagccaaacactgacaatcgatagtttacatggacaacgacaaagtcggcatcggtaaagtgcgagtaccggtgtcgttcagagtgtgcatcgctcttgtaatagtctcgaccgtgcaccacgaccacgactcgaaacctactggcggcgaccgtaccctggggtttgtacacgttgagtgtgagacagtgttcggtgcccagagagtcgccctggatgcactcaatgtcagtgtctgcgtgcatagtgtcgtttggtgaggccctgtacagtttggcattgttgaacctacgaccgacaccatagggtatccctagaaaattgacagtattggttacctgatcatcttgtccgacgagacaaccggcgtcagttttatactcacaacaagcgcaacatttgacaaggacgacaaacagactgcataccagcaacaggtttgccatgttgctatagttgctgttggtagttgatgttgttgatggttgatagtactgatgtttgatattgctgatgtttgatactgatggttgttactgatggttgatactgattgttggtagacgtgtttctagcagacggtaaactgtaacacaaagggtgcttgtattaggaggatgtatcttgttttttaaacactattggtatactatttatactactttataatattatttaaaaatattatttaatattatttaaaatattattaaataaatatatatatagttgaataaagtaaagtaaaaagttgattaaaaaactacaacactaccaactaggaatattaaacactagatgctaaacctttacaaattaaacctttacaaactaaacattgaaaattaaacatcaactctacactactgactacaacaattcactcaggaataatgcacaaatacatatactcaagaatacgaatataagaatatcagaatataagaatataagaatatcagaatatcagaatatcagaatataatacaagtaggtacaagaatataaatacctagcaattattattatacactacaaatgaaacccaagaacaagaggtacccaccaacggtaaaacaccaactgtggccgtctgattgtaaagcaaatctcggcctccttaaatagtagatgaccgattcatgtgcacatacatgtgtgtgcgataaggtagaggtgtacggtgagctataaactttacacacctagttttactcttaaaactcaggttcaacgcagtgggtatagtgctactattcagtcagtggaacactagggttattgtttctggcttttacattgtatgaatattatacacacaggcatatataatctagaaaaatcatgcatgatttatcacagcgtgtagtaattcgtcatggtcgtaaactaagaaaaccttcaatttgtacactattgtactacacttgtttgctaatgttgtaccacaagctctcgctctagactttggcacacgcagcatacaccggatcggtcaccgttagcgtgttgattctctgctgcgtcttgggatggttgactttgatgtagtaccggtccgttgtctggggatccttgtggtcgagaatcattcgtgccacctctcgattctccacaacggtggccagattgtatcgaaacacgtgcagtccaaaacccggatacggtctgcacttgcacacggtcatgtagtagcgtttcagatggtagctcaccgtagacgtggactgattgaacaaaacatcatcgataccgtagcgctcaaacgcctccagttccctactgtaaaactcggacaatttacctagaaactcttcaaactgattaaagtagtagactcgccattcggtgccgtttttgcgcttcagcggtatcgttctgtctttgcgcaacaactgccacagatggctgactttgatgcgattcacctccaccgaacgcaaccctgtatagtaggctagtagtatgggatgcgtatagcgatcggtggacactagctctttgagtgccttgaccaacacttgaatgttttccgtgtccgggtcacggttctgaggtgggttgttcaaatcaaagaccatcggtgagacaaacactttggtctcgggccaaaagagcggtttcagtttcctaaagtagagcttgaacgtggaccatttgactttgcgcaagtacatttgacgcacaaaggccagtgctctatcgtcgtcgttgtcgtactgttccagatgcatcatggccacctgtttcattagcttgttaatgtacggcaaacgtttggcgtgcttaacgtaggccgcataggctttggcattgaccagtctgactcgtcgtcgtctgagtctgcgtggtctgtttcgattgttggcattgttgacgattccactagtattggcatcggtcatgtcatcgtctccgtggtacgtttcgtgggttgcttgagctacactttgctggagggatgtcatgttatgttgaagtttccggctctggctcacacaacggtgcaaacgtatgatacgtgtagaggataaagtcacgattcagaaaaggcatacacgccaaggttctgtgaagttccaactcttgctgaatccaattgttcttgtttagaattagaaagatgcacgttacaaaagtcaagagtagaattagaccatgcatcttagcatggtgtatgaatatgaatgaatatgaatatgtgtatcaaacaaaaagactaatctcttgttgaaaaaaattgatggattactttaacatttttacagtactagacatttatcaagtattattaattattaaacattgctaaatattaggaaacatggatcaagtatttattaaatgtagctactaaaggtatttgctaaggatatctaaaggtatctactaaatgcatctactaaataaatgcatctactaaggattataataaacacactcacaaatcaggaacgatactgctaccgagacttgagatttactctgtttacttttgtacactatatcaagtgtatcagtgtggctcatactcatacacatactctaacattaaatcagctgcaagtatagttgtactttttaccagtatactttttacaagtatattttttaccagtacacttttcaccattgcattaaactatacttgaccaaatcactacactctttacatctgagttcccctcctggagcccctgctgcggctgcgtgagcgagaacggctcctgctgcggctgcggcctctgccagatcgggcagtgctacggtttcccgaacgagagcgagaacgcgacctggatcgtgaccgtgagcgagatctacctctgggcctgcgcacctcgcagctttcgtcaatttgacaagtttcaagagtcattgtgaatagggcactctctaaactagacactgggtgcatacaacaccaatacggtattggcactatgcaccacaatagcaacactttacatgttacggaaatgtgccaaattcacacaatccgacagcgacagatcaaagcgtacactcagcgagtttagcgtcttgaagggcggttcagcttcggcaaaacccagtctgcacacgaaccattcgtggggttcgtcgtctacgaggatgcgagacgatttcacggtagccactcggtccaggtcgtagcacagtgtggaaaatctaaagatgcactgcacactgaaaaagtgaacgtaaacgccttgtccattgtttatagcaaagtgcatgcgtatgcgttcattgttgccgtcgacgcctgatgttccgtaacacactgcgttaaacttgcaccggacgcaagattgctgttcgattacccacagtcgagacggaaacaggtcgtctacgcacatggtcggattgtcatacttggacagggtcacttcgcattcgaatccctgcgagtctacgagacgccagtgttgacgctcaaatggaatcttgataatcttggtgcacatgttttccgacgctcgcttccgtatgattataccgttggcgtaaaagtcaaacttgtcgcatttgctctgaaactcgatcaattcggagctgtccttaaagttttctacgataaacaatcgaccggctcctttgaccttttggttgcgtatggaacgcctaatctttttcattagtgtgtcttgagtgcatctagcctttacttttactttaggtttcagtgatgaggattcagagttagtgtcagagtcaggttcaggttcagagtcagattcagtatcagtaccagaaccagagccagagtcggtatcggtaccatatgcaccagattcacattcagatgatctggaccttgttttacgttctgcctcagattttagttttatagaatccaagtgtaattgcaagtcttctcctggatcaatttcaatgtattctgtgccgtctgtggttggtgttgatgtatggtccttgtctttattctcagttgtgcatgttgaattgttggaattgttagaattgttagaattactagaattactagaattattagaagttacatcaacctcctcatcatcatcttccttgaaaatatctcccccaaagggctcatccgaagtgtagcaatcggcaaatacacgtctggccacatccaagcgttcctcgtacgtattgtccagtatggatttaccattgaccagatagagatccaacagtacaaaacaataggcttcatcgttgccgttgatgcatcgcgaactcgaagagtacgatcgcagacaacactctacatcggacgtaccgtagcccatgagcataaactctccgcaaaagtacgacagacccttgaccgagggcagtgctcgtaggatggctctattgttgattcgcacccgtacaccgtgcctgtttagcatgtagtacttgcagtcttccgttaggcacagacacaggtggactcccttgaagctgggctgtacgcaatagtcgctgcacatggcgtccagatcggaaacgttgagcgtggcctctgtctcgtaggatacgctcggcagtttgtagtaggccatcaagttggtgtcgcacgtaaagacgctacgtgccacgtgaaagttgtacatgccgtgaaaaagatcaaacactatgggctgatccttgatgtcgttgcgtatgccgaatcggtagtattcgggcagactgcgagtcagatcgttgacggtcacattgagactcatcgacgatataatgtaggcctctagcggtgtgcattgcttcaagattaaatgatgcggtgtcttgaacaattgtacaatggtcagtctgtcgtcgttggtttgttttttaggacaataataattactggcatcttggccgcactcttgatagtttacgtctagacgttcaaatgacgcacactgttgactacggcgtttattgcaaggctccaattttacagtgtctataaattcaattttactacaaccgcttcgaaacactttatcgctatagtagacaaagccctcgtcctgatccactagtagtttgcaaatcagtctggatgcgtcgtcgtcttcgaacgactcatagtcacacttgccaatctgttggagaatctgtttggatatcaggttgccccaacgattcaaacatgcacacttgtcgtgcatattgatgacaacctttttggcagtcctccacgttgcgatgagttgacgacgccactttttgtctataaacaatcgtatgcaacagtacatggattcggcatccatgctggtcagccacagagttagctgttccgagtttttagcatagccgttgaggaatcggccaatctctatgagtgtaaccattgtgtttatttctaacggataagaaggatggtaaattctaaaaaacaaagtcaacattattctaaaactatattctttaacaaatttaaatacaagtgtaacaaatctattaggtactacaacaaatactaaatactttgatactttgataggtgcctacgttcaacttgaaacacacacaaatcaatttaaagaattaccaccagtactagtactggctctatttaatctttccattagatttaaccgctcaaccttgttcataacatctgcgctatcgatccgactacgtttggccatgtacgcctcgtagtcaggatcgcgaatcgtactcgcatcgtactcgtaatcgtccgagtctacgattcccagattgctgggcactctgtacggcgccagtagaggatacggctgcggtccgaatgccgaagtgttcaaaacctccacccttggcggtagcggtcgtttgcgatcaatcaacggtcgatccggtttcagatggattcggctgcgattgatcgcatcgatgatggcatcagttttcgaaacctccttgtccgcgttcaaatcgtcatcttggtagccctctgtgaacatggataaggtatcctgtacgctctctcggtgcacaggtcgtctgcctttgaatctttctgcagttccattgtttgctacattgtatgacacattattcacactgttaatactggctgcattgtttgcaccaccgatagcagattctttaataaacggcttgtaactttgttcgtttatcgtattggtgttatcgctctgccgagtattgttgtaatcgttgctttgcacgttcaatatgttcgaatcgttttcgaaatccaaagttagattagagtcgtcggcaaactctgcatagtcgtcgtaaatgtatccatcctcttcgtccacatcttcatcatcgtcgtcgtaatcttctatctgaggcggtaccacaaatggtgtactcggacgtttacgggtggtttcgggagattgaggtttctgttgcttggacgattgaggcatttgttgcatcggaggatgttttagtagagttgtagattttactgatattgtaggtttctgtgttggagtgggaataggtttggtagtgggtggtttaggaataggtttgatggtaggtggtttagtaggtttaagagtagtaggttcattagtggatttagtgataagtttactattagtagactttagagtatttatagctgccaagttaggaatgggtctagatgttggagtagtaatgggctcaagcttggctactcttagtgtagggtcaagtatacttgagggtactgtatttgaatctatacttatacctgtatttatacctgtttttatatcggtatctgtatatcgagactctctgactcctcgcatcatctcatctttcaagttttgtatagtctcattatcaatgccgccagagagtccgatattaccattgctgccagcaatcccagtattgctcatattggctccagtaacagcaccggtaccagtaccggcactctccgatgcaggcgtcattttactaaaatcgataccggcatcgagcagtgccagtctcagcaagtctccggggtccattggttttctaggtttttcattttttggaagctttaaatttgtatcaaactctgtattggcatccttgttgttgtagttgttgtagttgttgttgccactaccactttcaaaattcactagattgaatgatgcattgtttgcattggatggtgcattgtttcctttatcgtcatcactgtcgccatctcctaagcctcctcctcctacatcctctgtgaatccatagtcttcatcgcgcagcattgtcaacaatagattccgattgacaatctttagcttgatcaaacccaacgatgtggtcggtgtgtccataatgtaacgcatgtacgattccctaagagtcttgttgattgcatcgtgcctaaccgtcaccattttatagtctagtggtataaagtctatcgagtcctcgtccatggccaatggattcacttgaaacgtaaagtgtcgtttgatcaagagtgcatgtttgatcaccggcaataggatcgtgtagagcggctcgactcgtctgagcacatattgccggcgattggccgtgtacggtgtctgattgattaggtgcgtgtactttaacgattccaggtgtgcgatcggtacacgggtgcacagatggaggcacgaagcgatgacggtatcgattgtgcgcaaattgaccatgcccatgtcgttgactgtaaacgttttaaactcttgaatcaatcgcacaagggtgatggtaaagtttttaatcacgctaccggtcagagttccgctcttttgttgcaacagtccaatcttgggataggtcagagtgactcggggattgagagacttgatcgtggtcaatatgctaatcttgtagttgtccgtaagtttgggacgctcctttgtaatttgctcaaagacgctctttatgttggaatctttgagcgtttcaatgttaatctttagatcgttcaagagctttaaatgggacgcctttacgttgctcattataaataatcttgatgtaaataatcttaaataacagtataatttagatcctctataaaattagatatcttttctaggagagagaaaggcttcaactctctctatatagttttgcccggaaatgatgctataaaaagggaaacaataaaaagcaagctgtaaataaatgttgtatctagagaccgagataagttaaattataaaattaaataaaaaccggataataaattatcaacggcactctaccattaactaatctgtattatgattattattattaacaataatagccacattacagttttacaacctctgattagaaattgtaaactctacagaatgaataatatcaataaaagtatagatgtagtagtagatactacacatttatgctataaattaagttacactgtagtcaatgtggtgtaaacttgtctagcaatgggctcggttgcaaattgatattaaatattattattatcaaccaagctacagtagtagtgtagtatagttgtagaggtttggtggggaggtgattatttctcacgacttctcaataacaccactagtcgtcgtctgtcagcagtgttaaatggactgttggttcggtgtagttattattatacttttagtgtaggtcggtgtcatttttaaatagccatataaacgttaaatatcataaaagcaataacctattgaggctacgtttgcgtactaaatttaatttaaaaacagtgttttgtgcacatcatcgagatgaatgaaattgagagaatcgaaacttttacgagctccaactggaaggactcgatgattctgggtatgaaattggccaaaactggtttctatttctgtggagcaaatatattaaagtgtaccttttgcaagtgcatcctcttgtggaacagcaaagagtaccaagagtttgtaaacaaacctcaattgatacacattcgtttgtcaccaacttgcgagtatgcgtacgcaaatctgcccatgtacgctaatccccagtatcggtatttcaagtcgagactcgattcgtttatcggcaactggagcgtgttcaagaggcccactccgatagcgttggccgaggcgggattcttttatgctggcatggtcgattgtacaaagtgtttctattgcgacggcggactaaacgattggaacccgtgcgatgatccctgggaacagcatgccatacactttgaccgatgcgtgtttttactgtacaaaaagggcccactctacgtagagtcgataaagaagaggattctgggtgagttgtgttggttattgctattgttgtcgttttaatatttagtattgtttttaacatttataaatgaacacctgtacttgtgcacatgtatcgactaaatttacactcttatatttatactctcactggacggtaattaaattgctgcaaaaagtagaataagcgatcccttgagtgtgcatccttcaagtgtagataaattaaattaattttgtctataaattgattttatctataaattgaatttgtctttaaattgatttcatctataaattgagtttggttataaattgagtttgcaataaatttagattgtcgtaaaccatttcatctgcatcatttatttaattcaggcatataaaaaaatccaagtcacatttaatctaaactatactcgctcactctctctctctgtactgtatacattccacctctgcataatacacacactaacctttgtaaatatttaaacatcccattccatgtccattcaaggtggtggttgtggtgcagactcctcagagtgcaatgattgccaatttgacaaagctggcactggagagaatgtacgacgtggacaatcttgcagcacggatgccgaacctgtacttggttcatttgagtacactgattgcaatcctgctgatactattgctgccggcaatattgtagacttgaagaatgtccgatacggcagcataaacactagcgtctcttcagattgctcagaggacagtagcaacgtgtacagcaatcgggcaacgattagcgcaacgcccgtggtcatacaagactcggaggatgagcaatttatggatgattctaaaagtgtacacaaaggctctttcatagagtaccgggccatttctaaaaatgaatacaaccagaatgaatacaaccagaatgagtacaaccagaatgagtacaacaagaatgagtacaaccagaatgagtacaacaagaatgaatacacttctaaaaatgactacaacagtactatgcgcagatgcaaactgcaccgagtcaagaggagtattgttgaaagctttgaatctacagatgcgactcccaatgtagacgttgacgctatggagagaggtagaggtgctagtgctatcgagaaggctaacactatggataattccaacaaggatggtgttgtggaagagtcgattgttgttgttaatggtagcactattgatggtagcattgttgatggtggcactattgatggtggcattattgataccagcaacgttatcgaggcaagtattatagatgtggactcggaggtatcacaagtgaacaataccaatacaggatctggcaatgttggagttgaatcaagtaatgtggagtcaaataatgtggaaagaagtaatgtagaaacaagtaatgtagatgtaaatgtggatgccgaatcaagtaatgcagaggtagatgtagatgtggacgcagaatacaccaacaatgatgatgctactaatgtaggagagactactgaagataatacagaatataatacagatgagactacaaatgaaaatactgatgaaaacacaactgacgatacagatgaacatactgatgaaaatactgatgaaaatacaaatgaagatacagatgaaaacacagacgaaactacagagtacaacacagaggactacaactctacagacgtcaatatagatgccagcaggattgaaacaatcaacactagcggtaactgttttgtacattttctattgacagacactcgtttcctgaattacacattgtcaatgcacgcttccttaatacacattgtttatacatgcatgtacaaataaccattaaaattaacctcttaacaaaaagtaccatgtaaaacactctctccctctatcctccacagatgcatcgaccaataccaacatttcgataaactccaatttatcgctcaagcgtatgattcaacgattggaaaactctgacattggacgtcgtgcaagaccaccgacaccagagcgctgcaatgtacgcaatcggcctcggataatctacgtagacgagaccattggtgagttgtaaacgtccctttgtgcattaccaaaacttgcaagtaaacttgtaatttcaattgtagaacaatattgcagccactactgttgctgctgctaatgtttccactttagtgttggacccttcaaaatgttcaaactataaccgagccagaccgtcgttaatttataccaattgtaaatgctattacaataatagtagccgcaaggatagttgacctgattcagagggtgattatttacacggtatgattagtgtgatctgctcttagcaggtacttggttgataaatatgtgtgtgcgtgcatttgtttctagagcaatgtttaaatgtaaatgtaaatgttaatataaatgtcaaacacctataatatacatctttatgtgtatagtaaaaagatgtttataaaatcagtgtacttacctatatgtatatcaatttgaaatctaaatgtaaccttctacaaatccatctacaaatccttgtctttacacatttcatgcacagtttaatggttcagagaattatgtccagtgtcaaatgtgtagacgttagtttagtatagggccatgtataatattctagactcttgacaccaacaggtttgacaataaatccaatagtcatgccggctagttatagtcaaataacagtcgagttataataattctaatttattgttgttttaatcatttactgttagttttggcacgttatggctagttactgctagattgatcatttactgttagacctttagtttaccgttagtttaatttacttaattagattactgtttggtgttgcatttgttgtgttttgtgtttgcatttgcgtgcgtttggtttggtttttgcatagagggtctttttgtgtatacttgcactaaatgtatgttgtacatacttgcaatgtttattgtgcactcttgtacaaaatgtatgttgtgtatacttgtaccaaatatttgcactctcgcaccaaatgcattcttgaatgtaaaacatgtatattcttctcatacaaaccaacctccatttcacagatgccgatgccgattctaccattgaagatgaacgttcaccgattgactcttctggtagtttggttaaacctaacaatgatgctactgctactacttttactgaaaccactaacattagtactaccgccaacattgatactcttcccatcaacactgatactaacagcaacgacacttttaacaatgcatcaggttataatacatcatcttgtaatgcatcatctggcaatgcatcatctggtaatgcatcatcatcaacttgcaacacaaattacaatacaaattacaatacctcagactataatgcatcctacaacaaccacaactcatcctataacgtatccaacaatacaagtacatacaagcacaaccatcaacctcagtctcaacctcagcctctgtctcagcctccatctcaggatcaacctcaaaatcaacctcagtctcaccctcagcatcaatcacaatcatcccagactataacgttgcacactgaaactggaacgatagacctttgtactgcatccgaagacgaagaggatgaggatgcaagtgactacattgacgacgaaccctactacagggacgattgcggtaaagtgatttacatcaacaatagtggcccattagagtgtagcgtgtacgtggacgaagactgcacctcggacactgaaccacggccagagtttaaaactatacagattgtcatcaagtctgaggatgtgtccagaaaggccaacaagtacaatactcaaaacagtaccaacaattttattgcaaacaatactactggaatcaataaccatagcaacaccaacactaacaacactagcaagtatacaaacattgacaattttatgcattttcatcagtattacaaaccacaaaactatagcagccaaaaccaggcactggatcagatgcacaatcagtttaatcagattcagtcgtttaaccagaatgcaccctttaatcagtataaccaaagtctggcattcaacaaccaatgcaccaacagtcaatgccagtgcaacatcaacacttcctattatgaatcttgcaacgagtcggaaacctactcggatccagaatactatgatcaggctccagactactctgaaatcaagactagcaacaccattggctgccagactagtgtcgagaccaatgtcggcatcacgcagacggacgaggaccattgtcgtctgatggatcggtccacacaaacgttgaccggtggtaataattacatgccatcaaactcttcactggactcggcctcatcttcatcgtcttcgtattgcttttacaatcgcatagattcactaaatggcgttattagcaattctataaacaagtctatcgaacgcaccgcactcctttccatttccaattcgtttgaacgcactcctccaccttgttataagcctcctccccggtactcatccccaaagtttcttacagttgacgcgtccaccaacacggagattcagaagatggatcagcatcagcaaacggacgcatcggtggtggtggtgtaaccaaggttggagtttgaagttgacgtcggtgtaattgttacaagttcaaaacaacgggatatctaaacacagtttaaatgaactaatgtttttaatgcacacaattgtagatcaaaaaactagaatgattcaattaaaactacttttaatttcatcttgatcattttcacactattgtaacttgtctctacatactgatccttttcagactactattcagactacttttcatactacttttcatactacttttcatagtactacttttatgctcattctgtggtggttgttaattttagattagtgtcttagaataggttcagtttgaatttagaattaaactatatttagaactacagttagaaatacagttggaagtgcatgtttaaatggtttacatttagtaatacacaagtagatttagaaatagagttggtattagatttagaaatagagttgttattagatttaaaattagagtataaattaaagtataatgtagatttagaattagccattaaacagtgtggttagatttaaactcaaaatgtacttttattataaacacaatccatctactgatactacacacatttataaatcaacttcatacaaatacatacaactgcatataaatacatataaatacatataaatacatgtaaatataaaaaggtacactacaacacacacctcacatttacaagcctgctataaaagctaataacccctcagtcacttgggtactctttttttcaaagggtgtaaacaaggcgcgtacaaaacctctaacactagtggttctgcatactacacacaataacaaacactgtgggccacagtatcggtaaaatgtcgaccgcctccgctcatgttgacttgacgcaatccctgttgctgtaccgcaatattacaacgagattgaagagtttctcgagatggcccgtcggtctgcaacagtgtccagtctcgttggcagaggctggatttttttacagcaacatgtgcgacgaagtgcaatgttacttgtgcggtgtacgaatctcgaaatggctaccggaggacgatccgtggattcagcacgccaagtgttccaaaaattgtcgcttcctattgcgaataaagggtgtagactttgtgtacaacattacaaaaaactctacgtttatgcacaagactcagtcaaaggccaactttgcgcggttctttatcaagactgcggtcgttcaagacactgcggatcgtcagggtgagtgcctgctgtgctgttcgcatcgtgcagatattgtgatattaccgtgcaagcatctcgtttcgtgcggctggtgcgtgaccaaacagttggacaagtgccccatgtgtagagggccgactgcagaaattatgaaaatttacttttaatatttatatacagcttatcgaccgtaacgcgtatagcctattggtgttataaacggttcacatttatgtagttctgaagcattgcgttgcgagcattctcatactttgcgtgtgagcatactctttaaccttttgcatttgacgataatttaactcgacaccatgaaccgcgtaccgaaaaccaagtccatcacccaccaggagctcaccgattacatgtactatgagagtggagattttcagacaatcttgaaaatcgactcgttcaacaagactttgtcgttttacgaacgcatacccggtgagcttgtagaagatctaaagccccttcattggactccggcctgttttgacgagtacgttaaagttatcgatgccgtaataccgggagtgtacacttttgacgttgtcgtgtacaatggccagcagttgcacattgtagatttactatcggtcaacggtctggatattgaaatgtttacgtacaccgatcgcttggccaagattgcaagtctgtttgtgagcaagccgcccatgcagattacttttaaatcgctgccgacaagcagcaacaaactggaaatgtacaatggcccgtgcgattgtttgatcgtaaaagagctagtctcactaaagtacaacatggactacaagtatgtaacgcctcccaaagtgtacaagattgtcggctgtgcagacttgattcagcgacagtacaccaccgatgtggccagatggcgtagcgttgccaatgaactcgaactggaacccggctctgatcccaccaagatttcggccagttgcaagagtgtgctcatcaagacggccaaagccaatgaggtgctgcgcaacattctgacaaaggtcactgtcaagcaggtgcacctggttgccgatgccaagaacctcatctttggctattgcatattggacgattccgtactgaagcacgcacccaccgtcaaagagtctaacggctacacttggatgatggccgatcacgatgaaaagtttgccaacattaaatacttcaagactcccagtgtggcatcgttcaatcacaagacatctggcaaaatggaaatgtacaagctgcagatgcaccggttgatttgcgatgacagcgagcacgttgtagtgtccaatctgccggtcaggatgcgcatagtggcagccagactgtccaagagcaacctgtccagtttgattacgatgttgattgaaaagctgcacttggtgcactttaacgacaacattgaagagtttacacactacattaaaatgttggaagatttattggacaagatggaccaccaaggtggcggcggttccattatgagcactacgttgccaaagaagcgttcccattctagcgaagagaaggacaaaaatagcacagcttccaagaaggcggacgttgaggaagctgaccatgctgaagaggaagaggcggagtctgagccggccgataagcgttctaaaaagtaaatgtgttgttggtagagttttagatgatgtatcaataaattcaatagatgtgtgtattcaataaatgtaggtatcgatagatgtgtgtagcagtagatgtatggattcaataaatgtatgtattcaatagatttactaataaatgcatctagctataagtttagagaataggaatgaatgtagtctttaggttagttttagttttttggtaaagtagatgtaagtagggagtaaattaggaggtaaagtaggacgcaaaacatgtagtagagtaggcgctaaagtatgtagtaaagtagttgagttaagtaacctagaataaaggaatcgtaaactattacaaccactgctacctattcaaactttgacttgctatttgaatcttactttgtagtatgctgtgtgtttgacaaaaaccactgataccttttgtcttgcaactttgcattgaattagggtcgaaatgttaaaggattgtgtgtgcgtgtgttttagttttttagaataatgatactttttattttttagaataacaataattcttgttttttagaatactaataattcttgttttttagactaacagtttgatttaattttttagactaacaatttgatttaatttttttagactaccaagtcataaataaatatcaaaacacagttgtggtacacgtgctgggaatcggttacgtttattaggttaatgtgcattgcgtgcgtgatcagagttttaattaaaacataatgtcagcgagagagaaatctattagaggtgtttctaaaatgtaaattataggatataaaattagcattagcatatagtctaagggaagagttgtactgagagatacttttgcaaagttgtaccggatgcattgttgtgtgcacatgtatttaccagtgtcctgtttgttcacattttactgactagtgtagtagtagcgttattattttagcattgttgcactgtattgttgctgtttcatagtaagagtagtacaagtctctctgacttgagctttgctttgcacgattgttttgactgttctttgaattggatttggtgttactatgtaggattaagtgtactggaataaaattaaaagtattggaatacatttaaaagtactagaataaacttaaaagtattgtaataaaattaaagtactggaataaaattaaaacctgttggtgataagtttggtagattatgtttttttgatagttttaatattagttgtgacagttttatatagttgtaacacttgcagttggcaaagctataaagacggcttgtgatgtaatgtttatttgctaacctaaacttgtagagtacgtaagtaaataagtaagtaggtaagtaagtaagtaagcaactgtaagtacacaaactccaactcgtcattctatatgtttttgttgatagaggtagagagagaggtagagcacggtatatcaggttctaaacaagccaatcacttgtatattaacttataacatccaaacgagtacccttattgtaaacccatccaatcctagattacttgctacttgcttgaataaatgttgtgtgtagtataccaacacgtttcatttcaaagacccaaacaaccttacttgcaagtctacccaaagtgcccatataacaaatatccagaaactataatgtccaacaaaagtggccgttgatgggtttagataagcttacacctttccccgggcaccataacatttacgatttccgtataatgtaaattacccgaccgttacctactttatttataggcgtgtaatttattagcattttatgaccaattcaacaatttacaacaacattaattagcattgtaagtttgtattatgaataagaaaagttgatctgagcacgcgcacacactgtattgtacagtgctgtgtactgttgcaacaaagttgagattgaaaggtcaagtgtaaacacacgttccgtgcgttgaacaaatgacgagtcattggacctgtaatgagtctggtgatgtgggtagaatggtagatattaggtagcagccggtagcctttttgagtaaaagctgaggaagtagatgtgtttaaaaaaagaacaaagtattacttgactagtatatatatttatttaactacaatttagatacatttatttaaaatacatttaacattaatattcatattcatacaaatctcatataaaactaaacctctagtaaagactacctcaatcctcccatcccttcataatttcatttacacgcaaaaaggcagccatcgagtctatgttgtactcggccatcgtgatggttgcgtgcactcctcgctccttgacgttggcatcgtagatggcctttgagaggatctgatagatggtagtgttaatcttggacacaaacttgtacagattcaactgtgaaatgtgcacatcgttcaagtgatgggcagcctcaaagattacatcggtcggtttgtttttcaagtaatgaaagtatttgacttgcttctctccgaatatgtaatcgggctcgtcctccacaacggctcgcatcatctttgcaatgggtgtgttggcagtgtccaccttttcacgattcgtgctcatcatgcacagtactacgctgcgatctttgcgtgcacgctctgcaatgtacatgtacacctcgttgactagaatgtcttgtagcatctttgacgatatcggtacgcgctcaatcaggtagcgctcggccagtgtaaagatgacatcgttccaaatggtgggaccgttcttgtttatacctctcgatatccattcacccttgcacttggccagatagacctttttggccattataaagatgaactgatacatcttggcggtcagttcgagttcctcattcagagtcttgcaaaactcgggcagtggattgttttccagattcgagtcaccattgtgtacaaacactgaatcggtatcgatcagtactgccttaaagttttgcacatgagcaaacctggccatgtctataatgtacttgcgtcccagagtggtgagcgctgcagccaccagtctaccgctgagcgctccatagtcggaacccaagagaccatagtagctgcagttgacaatcttcaagttgcgatacaacgagttgattcgagacagttcacccttgagtttaacctcatagtcggtcagcaattgaacatcgttgcatcggttgatttcgtcaaaggttagcagtttaaacttgggcactagcattttcatatcactactcttgtccacatcggcagtgttgaatatagagccagtattgcaaagttccatattctcagggttggaggggtcgtcagtgttagagtcggttttagattcagtattggattcagttttagattcagtgttggtttcagttttagatttatcctcagttttagtatcagagtctttgtcgtcctctttatcctcatctttatcctcatccttatcctcatcctcgtcctcatcctcctcctcctcatcctcatcatcgtcgtcaaaatcaaacacaacctcttgatagtcgtcgcctctattctttaccgcatccaatcgtatctgcacctgggtcaacatggtctccatttcctttttcaaatccttggctcgagatcgtaaaacgttttgtttgtgaatcatgttgcccaatagagacggttttcgctcaacgctcaatattagcacacgatcgttggaattcaagtttttacaacactcgtccaatgaactaaattcatcgcaattattctccagcatattgatcaggttacgagtgtttgcatgatttacgacctcttccttggaacacttgtgcacggtaaatgtgaaatatctgcacggatggtttggattcagaatgggtctgagtcgctgcagtacgtgcaccggaacgattgcgatcgtttcatatgaaatgttgtgaccctgtttcaatttgggataataggcgaccacatcgttcactttacaattggtaaacacttctcgggcgatgcgcatattgaatcctccaccgtagctggcctcgttcacgcccgccgacacttgattctgattgtacgtgtacatgacgctaccgttggtggtgatcattagcccgccaccgatgctcttgtgcagtgtcaaaatcttaccatcggtcaaactgctgtagacagacttgttgttgataaactctccaatcttgcactgcgtgtaccgtacaatggaaatcaaatggctcttgcacagcttgggtagaaactcgtcgtagctgagcgagtcccacagtcgacacagcagctcggtatcgacatcgttgtagtgcacaatggtggccaggtcaatgttaaacttttcaaagtggcactcgtcattgggcaggcctcgttccaagaggtgccggtacacgtgtcgaatgttgatggcgttaaactccaccttaccctcggcctgacccagacacaatttggccatagtgtccagcgacagcttgcccacctccggatagagttgacgaaagattttaatcaaatcaatgtgaatcatgtgatttccatacactggcatgcctcggtacagggtaaagtttttaaactcgggcagacacaggtaggcggtgcgtttaatgagaaaagtcatatcgtaacccttgctattgtagcccaatagaaaatagagcctcttgcgatccaacgtctgtaggatgagccgaatgagatccacctcatcgtgcacgaccaccagtttgcgttgcatgttgcgagtggcttcaaagtctcgctccatcaaactctttaggcgttccgtataggctcgtaccgattccgagttggcatccaccgtatcggtttgttccaatcgtgcacgtttggccacagtgccactaccagtagtggtgtaatcaaaatccacaggcaccggtatattgacaaaactgtacattgtgttggtgccgtgatcctttatcgaggctgaaaacaaaatgtcattcttatagtctcccaggggcagtcggtaatcaaagctggatagagtctcgatatcaaaggccacaatgtcaatctttggcttgggcaagtcttcgtagcgagccagattggcgtcgacaaacacatcgtacaccgagcactcttccagactggcctgactcgtacggcacgccatttcaaagacaatcaacagctccagggaccaagtggccgtagtcttgatgtgattcttcagagcggtcgtgttcaagagtttgtgtaaattttgagaatcgccaaagctacaggtgggcacttgaaatgtcttgtactgaacgctagtcgtttgaatcaacgtatcgagcagagtattgttgggaatctcaaagttgaacgaggagagctcgcgtatgggccgctccaggtcaacgtgtctgagattgagcaacggcgtcagatgcatctcgttctcggcaaacacaaagagcgaggtcttgacgttgttgatcattagctttgccgagtccccggactcgtctacaccgaacgcgtaaatctgattcttggtcgatgcccaatcgaggacgtagactcggtcggtccattttatagactcgtccgaaatcttgttgttgtaatagtgttcctcgtcagcgtacatcatcgtgactactaaaccacaaaacggcgtcactaagcttttatatacaaacactgataagaaattgcatttaaaaggcactacacttgcaacgctaccatcattaatatagcgaattctgcaaaggcaatacgctattgtgcttatctttgacgctagtttattggtttatgcacatttttcatcatgccgatcagaaagaatctaaagtcgatcatttcaaaaatattcaagaaacgcttcaatgccaagtctttggagtcgatcattttggatgcattgagcgacgtgcaccatgccagggtgtcgatgagcgatgccaactcgcccttggattatgtggactcgttgagggaaaagatttgcgcctaccatattccgaagcatttaaaggccaaactctttcatcgaactctgccgcccgactactacctgtgtccgggcgtcgaaggcgtctcgtacacgggctactgtaagcgatgcgatatccagtatcgctatccgaatccgttgtcgtcgttgttcaacttgtcgaatctctattgtgtagagtgttgcggtgacttgtttgataggattgatgatttatacgtgttttgaggtggagacggtgcggttacttgttgttgagattaatggtgctttataatgtgtttttagattaaagtattatttaggtttttattacctagttctagttatggttgtacttagtttgtacaaataaagattttaatactcaaactgttgtgatttatatttttttagtttaccctgtgatatacatttgcatcaactacatcttcctactcctcatcatcaacctcacactactctacatactattctacctctgcaatcctcctactctttcctttatagggatgcatccataatcaaatcaaaaccaaagtctcagtttcattagcggaaaacaacatttgacttgtaaaatacagactctgggaatccattggattgctttacatggactgaattacaatttcattatgcatctacattggcaggtatcgatcaaaagcttaatttactgggtgtctggtttaatttattgactagctactgctcggctgatgggctcatgtttatgggatcatgtttatgtaatgacattttgagaattgtggtaaaactagatgttggaggctaacggtacggactcggtggtgatttatagagttgaattagttacgagttgaattagtctaaaaaaaatacaaaaacttggtaggtgcatttaaatacatgtaaatctctacctgttatctaaactttaaactccaaatctaacctctaaaatctctgtatgaaatctcagttcaagtctttgttaaaatccaaaagtatatacacatttgaatatccactgcattcaagttaaagattctgaatttaggttactctctcggatttttaagattctacatttgaatactctcaggaatgaaaacaactttgtattttaatcttggtttttattgttcagtttattaggtactagtagttgtgtgtgttttagtatttgattttactactattatattatgctactatattattattactactgctactatttactactatagtactactactaaaactagaaaatttacagcatttcaaagtgttacatttagtaggaaggtgcagggcagttaaacaactaggttgctcttaaatactagttacgtatctctaatactaatactaatactaaatcgtatacaaatcaaagagactttagtcacgagatatatattcatcaatcaatcatcacacaagctaccatgaaaacgtaggacactgcactgcatcaatcttgtaccgacgccacttgtacgatgcgatgcgggcacgagtggtcttggtgcattttctaaccttgaccatgttgagcgcgtacaagtctgaacactttgacttgtgctcctctaggacatcctttaccgattcgttcagttggatgctctcttcgaacgtgggcagactaagcatcattgcttcatcgtcggcaccactgttgggatccgcaacgacggtgttttcaaactctacactgtggaaagattcggcgcctcctttggatgcactctcaaagcgtgcagcactcgcagtcggcaacttgtccaataccgtagtctggatcggtctcagtctggtcagcactcggtagcagcacttttcctggctcggtatttgaggattgtacgtcatggtggtttgtgtttcgatgcttgatttgtataaaactaaactccaactttatagtcaacgcaaactttaaattatacactttaaattcaaaattaaatcaaaaactaaatcaaactcataactgaaactagtacaacacaaatggaaatgaagtgaccatgacagaaatattgttacctaggcacagaggtaattcaaagtagtaaagtaggtacaatatgatggaatgataataataaaagtctatatttgaaagagcaacatgtgctctttgaatggtttgtaatctaaaaaactagagtccaaacgcctactgaaattgtagctgcaacacaacttgtgagcaactaaattctcagagcaacgggtcgagctgcacgatgattgcactctatttaaaacaggcgcccattatagtacagttcaagtatagtacagatcaaatatagcacagaccaggagtagtacagaccaggagatgtacacttgtcaaggtttgtaggtcaactgaagactatcgtcaaatgttttggtttatatataccgacacaggatgtgacaccaaagggcgtgttgataaaccatttgttaattatagtcattacacaatgtattagtgctcagtaccacatcctgtatgcaattttccttgatttgtaaaatctattctaaaaaaccacagtaggtacaattacaagtaattaaaagagtcgttacaactaaacatgaacaaaagaggcatcttatagtactacaaacaaagtaatgcaaacaagagttgaaatcttataacctagcacacatgggagttttaaggaatctaaccaatactaacaccaacaatctttactcttaattaatactagcactctaaccaacactaatactaataccaacactaatactaatcaataccaatcaatactaataatactaaaacaaccactcactcggcatcctcctcgtcctcccctcgttcactgtaaatgctactgtccgcagtcatcaccgagcccatcaaacgagacacgtcaaacgcaatgtccgatttaacggtggatgcaatcttgcagttctccatcggtgccattataatcttttcggcatccttgttgatcttggcctctaccacatcgccatcgtacaagtggtcctttttcagtttcttgtggcgagtgttgagcaccgggaatgtcttgtttctacgcttctcggcactcttaccaatgttcataaacagagtgcctctgcccaggccactggtgcgcacatacaagtacgtcttgtcagcctcctctttgagcttacccgaccaaatgttaatcttgttgattttgtgcggtataatctttatgtagctctgcggcaactgatccgtgggtagacagtttagacgatccttccaagacttgaagtccaactgcacctgattcactgcacgcacatcgaaaatctcactctcaccgtctcgggtaaactttacaatatcgtaaatcttaccgtccagagtgtgactctcggtggtcaaattcagcggtgtatgagtactgtagccgtacacggttttggtgaatctggccagagtgtcaaagtgcttcaaatctatgggtagacaatcgtcgttgggattcaccacgtccgtgtaccggaaacaattgtactcgagatcgagtgccagagtgtgcaatttatcggccacgtccttgtagcactgttgctttagcaagttttcaatatagtccaagtactggatgcgctgtgcgaatgcgactcctttgcgtgacagtttgcggctagactcgcgcaaaacctccatcactgcccgctgtgcatagcgtttgttttcaatcttttccaagaggaacgacaacagtttggattgattcagttccatcaagaggctgaggtagagctttttgataatgttgtcattctgtatagtctcattgtacttggacttggcctccgagtacatggccagattgatgggtttcagtgtagacacggatccggacacactatagttaccggccaactcctcgtcatcgtcatcgtcttcgatgctagagtttagttttaaacgtttgttagagtcggttgtaaggtaacgagtcccaccggtgctgtatacactttcagcatctccattgctagcaacgatgctggcactggcactggtactggtactagcactagcactaatgtgatcatttacaacagaattgcaatcgtcattatcattagagtactctttggtggaatctttagaggcatctttaggttctttgaactctttaggtatgttaaactctttgggtacgttggaaatatcctcatccgaatccccatcaaccctatcctccctatcctcatccatacacccatctcgagactcggaatcttcaatgttaccgttactggcacttatgcaactattggcatttccaactccattgtccaacagtttctttacatgattgcacactctagaataggcatcgtaatcgttgatgcaactcgcatccgaattgtatccatcttcgtcgtcctcatcatcgtcctcatcgtcactgtcttgcttgtgattttgtatatacgcaggctgagcttgtataatctgatcagcttcagtctgaccctgaatctcagcctgagcctgttgctgttgttgctgctcagccttactcttgtccttgtcagtgtacgatttgcgcagttgctcggcaaacttttcgtacaccaaagagatgaaatgcttcatgtacttgtccaggttcataatcatgtcggtatcgtactcggaattggctccatagtagtgagtgcgtttggatgcaatcaccaccttgggatgagtaccgtacgtggtctgatagatgagaaagtaaataatattccgagccataatctgatactgattgttgcgctgcgtaatcttggactctttttctacctcgggagtgactcgtttacgtcgcagtttgagtgtaatgatgcgagccgttctagtcagtttttgaatcatactggcaaaaatcttactctcaataaactgttcaaattcctgaaacaatatttataggttaaatcgttacatcaaaagtgagattaaaacagtgttgaaaaatggacattttcctatgcatcgaaactagcaggattccaagtgaccctgaaatttacaacaaacccatatgcatggaatcgtcgattctctatgaaaagccagtaatcgatgtccaatacaaaaatgtacaatacttgataccaaacacgatcacgaagcagtttagctactttaaatatgcaatgacgatcaacgcctacaagcatcacatggtcgcgtacatgtttcgtatcaagtacgaggacgcgtgcaaactcgtaataaaacttacttgggagaatttgtttatgttgaacgaggccatctcgtcacccagagatatcgcactcttggtcgacgatttgaaaaaacccccaaactggacgtttatgacgtggctaatgtcgagtcggccaaactttgaaattgcctacataaattcaaaagacttgacagacgtgcgactgtatcaaccttatgttgtggaatgccacacaaggcgtatagcgtattataattatggcgacattacattgctcagataacggttgtttacagtagggtttgttagttttaatcgcaatgggtgataaaaaacaatggcttaccgtggagcctcccatgtttctatacatgatggccttcatgacgaccacggtcatcgagcaggcgttttacgtgtaccaagcgtgcaccgtcaaccatggctactcgccagaggtgtgccacaacattagccagtacgatgacatcaacaaccgagtccagcagactgtgtctacatttcatcagtggaacggtgtagccagtcatgtggtgccctttatattggcctttttcctaggatcctatagtgataggcgcggtagaaagattgtactcgtatgtggactcgtaggtaaactctttttctcggcaatgctaaccgtaaacagtctcaagagctggcccgtagagtatataatctacacggcatcctttccgagtgcactcaccggagccgatttgaccatattcgcagcgtgctttgcctacattgccgatgtgtcgactgtggagaatcgcacgctacgagtgggcatcttggatgccgtctacctgagcacgatgccaaccggtgtggcgatcggtagtgtgctgtggaagcgattccgatcctaccccatcatgtttgcaatcaatacgagtctaatgattgcggccacattgtacacgatcctattcctaaaatggcaaactcgaccagagcaaaaatccctcaaagagactggcctcaagaatgcactcggagactttttcgatttggaaaacatcaacactaccctgaatattctagtgaaaaagaggcccaacaatcggcgactctttttgtggttcattttgctgtcgatggccttttatacgtttcatcgagacgagcgctctgtaatgtacatgtatgcaatcaaagagtttaaatgggacacgactgcttatagccactttagaacctacctgagtgcaatgtacgttacggcgatgctctttggtataccaatcatgagccgaatctttaaatggaccgacacgctgattgtaatgctgggcgccgtggctcacatctgtggacacttggtgtacgctcacgcaaagattgccaacctatggtacctgggagcgacgctggccgcactgggaccttgtgtggctccgctcttgcgatcgatggcctcaaaggtgctgcctgcttcggagcgaggcgtagcctatgcctttctgtcggtgatggagaatgccgttggaatgtttgctgcggtggcgtactctcagctctacaaaaacactctggacacacagttttcaaatgccacattctacctgaccgttggcactctggtggcagtgtttgcactcatgctgaccatgagccgaatgctaaagggtaaacagttgaaggatgccgacagtgatgactatggaaactctaatgatgaaatggggcatgtattatacaatggaggtggttcggtacaattactgttcaacggaaaggttgccgagtaccgagatttgccaatcacaaatgatttgtgtaacccagagtttaggtatttgaaaaatgtaaaagagtttgcgtattaatgtgtagttttgtatgtggtaggataatgtaggtggtaggataggatagtgtagtaaatacatttatatgtacatttaattatatcaaataaaaaatgatgtattttttagtttcatcatttgactctagttttacattcttataaaaacttcaagttgtagtacctacattacaaaataaaactctttattttttagacaccaacatacacggcttggaatgagctcgtgtacgggatccctaagtacacaataaatctaaaaatgaagtttgtcacatttacgaccatcgatgagtatggatcgtttgacaacaagaaggccaacgagctcgttagagttttaaacaataatgccaattgtgtcggtgggttcatcgattactcatcgatgtatccattgatttttgtatttgcatcgtgcacagaaaccatgttttgctacaatctaaacaatgagcgcgatccctttgtcgatcaattggaggctctggtcaaagagtccaagattgtggtcgacgcacagcaagtgtgcaatcttttactagagggttttgtcaatttttcgtttgacgctcgtctaagagtgtgcgacattgtgcgtgtgctagagctgttgaattgtatgattacacgaaaaatgaaaaacaacatattatacggtgtaagcggcgaagctcgtaaatgttattagcgttgtatttgggtgaattatgataggtgcacggttgaccaaagtatacacatacacacaccatgaacaacgcaatcaacaatatccgagctcgcatcacaccggaatgtggccgactggccagtacggtttttgcactgggtatcatacaatcggtggtactggttgccatctcgatcctcttcctggcagtttacttgtactacaacgctgacgttaaggcttcgagcacgtcaagcacagccgatgaattggaaaagaaaaagaagaagattaagaccatgatgattgtatcgatcgtgctggaagtggtcacggtactggcctcattgtggacggtgctgactgctggcaagattaaggactgtgtttcgttggtttcatccacataaattgaagctgcctacatccaccgagtgctctctatgtgatgcgtaagagtgtatggtatacatcaagtgttgtgttgaaatgcaagttgtacatcaaatgtttaatatttaatacatcaagaggtaatgtgtagtatgatcagttgaggtgtttagattaagttgaggtcgtgttagggtagtttgttttagtttggtatagtataatttagtatagtttaggatagtttaggatagtatcgtttaggatagtctagtttggtaatttggattagcagtacatgttagattaagtcaagttctttagtaggataggttgctggaaataatggaatcattaagtacaagatttgtgtaataaagatagatgaactgataaatgacaacattaatgaaattgaataaattgaaataaactgaaataactgaactaaactggaaactaaataaatggattctctctacatctttggtttaattaattcttattttttaaactatagattaaactagatttaaaacaaaataacaaaatatcaaaataacaaatataaaatcaaacccaaaggcaatactcaaacccaaacccaacctcaaccacaatgctgcccgtctttgtaggaacactctttgtggtaggtttgttgtattttttgacattgcgtctagacaactctaaatactatgcctatgtcaacaagtacaatctacaagccaaaaatgaaaagctagccaaattgataaactctgagggactcgagaatctaccgtcactgctcatcgaccacaactcgtcctatgttcggcaacacgaagacttgtccaaggtgtcgcagtgtgccgcagagcctctgtttgtagcaccgctcgatccaaaggacaagactacgctgttgcagtacaatagctattgcacatcgagatgcggttccttgggccgaatggtggtcgtgagtcccagccaagagttttaccacatcaacaagcgtctggcacccggcaagtattgcatggtcgacaaccaggtaaagtgcaatcctcgcaccggctacgtggtggccgacggtctgggctcttgggtgtgccgatcaaagtatcccaacctgtttggcggtacggatgcgtccaaagtgattgcatgcaacaacgaactgcatccgtccaccggcagcatactgtgggacaatttgctaaatgcaccagtaaatgcggccaccgtgacactggacgacgagaacgaattggtgcccggcaccggaacgtataggttcacgtgcaagtttaacaataccaccaacaaccgagtgctgccgcatcccgcaaaccgattccatcccatcaacgatccgtgcactcgagaggtgcccaatgcgcacagcgatgctcgggtcgtgtttgaccacgacgatcgaggcgttgccgtggactggcattgcgattgcggtgatcccaaagtgaccaggctctacaattcggacgccaccgacaacaagtctacgtgtacgccttgcgtgaatcgaaccacacagacggatcgcaaactggacatttctgtgcatttcaagtgtttcaatctaacgtcaatggtgacggatctcttcaaaacggtaccgtgcaagtggtcagactttctgagcaacggcaccagttgcaactatctagaattggagctgtacgagactcgcaactttatgacaccctttgacatcaagtataccaaggttgatggtgtattattaaactaaccgagttttacctttgtccaaattttacacatgagctattgatagtaacgttgaggcggcatgttattagaagtcatgtcaagatgaatcaaataaaactggccaatgctaacctgtacaaaaaggccgcgctcatgtcatggttggagcgcgaccgaatagcgtgcgactatgttaaacgctacggtaccgagattgatgtggacgcgctcaagggactctttgattttgcctctcagctcaagctggaaagcatactggtgtcggtgggcaagtccgtagtccgatccggttccattggcgtgatcaactttttgaccaagattggtatcggcatcgatgccgtcttggatcccaccaagattgatcctcacttggacgatgacgatatgatttctctgattgagcatcgcatcgaaaagttgtccactcgtgaaaccaaaaaacattccatctactataatgtgaccatgaaaatgtttggtcagatgctcaatctgaatctggaaaagattaatcagtctatattcaagaatgttgacgaatcggtactggacaagctcagtgaggtcgcattcgatacgaccaatgaaaacattaatctggatcaactcaaacctaaaactgatcaagaactgaggctgatggaggaacctacagtggttgaactcgacaatgacaacactgggtcccatccttcgtatgacgtttccacaaacgaggtagagtaccacgagtctgagtttgaaccgttgcccgatagatttggacggtatcgtaggagtgtagtagaggacagtgtagaagagggtttcaatggtggtttggaggatggcttaaaagagggttttgaggatagttttattaggacagagaatggtaatcttaggacagaaaatgatggttttcttaggacagagaatgatgttcttaggacagatgatggtttaggtagtgcaacagaatcgagtgtaaaggatgatagtttagagggattggatacatcaaaatcaatagatttgttaaactcattagattcatcaaaaccaacagattcatcaactacactagattcagcaaagtcattaaattcaccagagaatcaattagagccaccgactgcactagaattggaatcatcaccaaaatcattacccgttgaagagctacaagaatcggtaaatgaggtggcatctccagtggatgcatctctacaatccaatgctatgcaatctaatgctatggacgtagactttgaggatgatgcaagtgttacacctctatccaccgagtctatgaatcctaaacatgtagagtatgcatcaatctctccagagccagatacggacaccgataccgatggctcaaacgatttggccaaattggacattttaaacaccatcgaagagtacaagaccaagcagacttcaagaaagcgcaaagcgaccactgctcccagtaagaacgagtggttgttcaaaacgttgaacgaagacgattcccgaccagattcaacgtttaatctctttgatgagcccaacggtgaactgagcggtctggcacaagagccaccgccagacaagctagactctgcaatcatgggctcgacaaaggccaccgcaatcatggatgccgactctcagtcaatggacgagccaccggccactatgaaccggctaccaaagagcatcctgaaacggacccttgaaatgggcagtgaacacgttaccaaaaagagcaagccaacgcgcagtgtacagtttgccaagaccaacacagagtttgatgtactgaacaacattaagccctttatcaaagacaagcagggaaagaatcaacagcagcaattgaatctgtctgcgttggggttgtctacagttttgtagggaggtgatgatagacttgtctagatttgtagagttgtatagaattgtttagagttgtttagaattgtttagaatacctagtttataattacataggagtttataggtttctataggatagtattagtaagcaaaagaatagtattagtaagtaaaagaatagtattagtaaataaaagagttcacaagtattgtaaaaaatatacatatattgtaccatgatgcatttttttaaactctaaattacattaaatatgtatatatatattataacataatattattttttaataaaaaattaaaactagtgtatacaaatatctcccaatccttctacctaaatcctctacacaaactctctaaactccttctcaaacaccacatttccagaatcgtaaaagtgcgatgtagtctccatcctacggtgccgattgaatctggccaccagacccaacggtagattggcaatcattcgggtcgtattgaacactcgtatcgactgtatgccaaagagttcatccggtgaggcaccccgctccaacagtgcggatcgtagcattttattcaatgtggatcgactgacggtcactattcggtccgagtcctcgttggtgtggctcgttaaaaagtctaggaatttcaatagaatgtcacgtatgtacaagactcgtatgaagcgagagcgcttcttgattttaatgtttaccttgcggccttcgacaatgtccatcagcgatttcctagtcaactgttgcagttcattcatacgcaaatttgtacagatgcacagtatgatggacggggatagttcggggtacagccacggttcactggtcacgtccagcaccagacgctcgatggcattgtgtgtgacaatgtccatctttttgtagagagccgtacgctttggtcgcacccatcccaccttgggaatgatcatggagagtatcttgcgatacttgtcccgatccaagaacttgacgattctggcgatctgtacgattgtagtgtttcgatacttgtccttttgagagactagcaactcggccaactgttcggctgtgagttgagccagatcaagctcagtgcccggatgcagagactcgtttgcacgttgtaaaaagttgaacgcgtaacgtatggctctaatgtgactgtcgctgaatttgacaaattgcaagcgatcctgattctgttcatattgtgtaggtttgtaatgtgtaggtgtagttgtatttttataatgtgtagggttgtactgtgcaagtttatgtgtaggtgcagttgtaggtttataggatggaggtgcagagtcgacctctaccttgaactctttctttgaagtcatgttaagagtctaaaaaaagatgtactagtattaaataaaaatgagtacatgtaaaataaagagtacatgtaaaataaaaagtacatgtaaaataaaatgagtatatggaatgtataaatgtaaaatggataaaggtataaatttataaatgtataaaggtataaatgtactctaatcacaacaataataatacaccaccaccatgatttgtaaaatgtaaaagaatgtaaaagcatgcaaaaactctatctactactaccactactactactaataataatccaaatttatcatcatgcacacaaccaaggttcacaacaaatgatgtaatacacaaccttagtaatacacaaccttacctgccatgtctttatattttttaaccacaatcccaaattgcacaaaacccaagtatctaggaataatactctaggaataacatgtaaaccccacacctaaataatactctaggaataacattacaattattcaaacaagtaatgtaaccattcaaacacaatggaagactgtaacgtaaatcttaaactaacattatattcttaaaaggaatgtataaaatatcattataaaatatcataaattctcaagtcttaaagttccttataaaataaatccttgtaaggaaatccttactagctgcaccggttgccttaaatctaaatttgttcgtcagttgcatataatcacattttgattcagtagcactttgagtatacttttttgtagtacaattgtacaacttgtagtatactcaatgtatgcatgcacgtatgcatgtactagaatatcatctagtcatactactcggtatcaatctcttcgtctttaccgattgaatcaccctcaccgttactgccgcctctaccagcaccatttctcttcattccatcgatcctagcaactgcacttggtctgccgcttccacgtcctctgcctgcactgagtctctctgaattgtcgtcaatcgaaccccgtctgcggtacatgggctccagtaccatgggtttgtccggatcgatcgcttcgtcagtgtcctcctcgttggcctctatcagtcgcatgcccctggtgacttttctgccgtcttcgcgttcgtacgaatcagacttgtacacccttgatatggtcataaacgagcatacatcgtttgtgtctccgatcacgtctagacggtgctcgtccaccgaactgatttcgtgtatgggcttgatgactagcacgtcttcgcaattgggacgtatcgaaatgattcgaacgttgatgatgcgcgaaaacgcaaaggtcgacgaatcgctgtccactacgtccacgagcaccgtcaacggatcaaactgatcggacgagtttacgctcaagtctttgcaatctataaaggagcacttgttgacctgaaagaccaccttggcgggaatcttttgattgtacaccaaaatgttgttaatgtgcaagttgtcgcactcttgcagatagattgcacactcggcatcgtgcattgtacagttttgaatcttgctaaactcgcagccttgcatgaagatgcactctcgggacgacaccacaaaggtgacgttcgatatggtcaagtacttgcagtcgaacacatcaaagccgttgcccacaaagaagagattctcaaacattaccagtttgcagtctcgcaccgtgaccagaccatcctccataatgtggctgttttcataggtgcaattgttcgagttttcataggttacattgcacgcgtctatggagcgcagtaggaccttttgtgattccaccaccttgagattctttatggtagagtgttccaagcgggcattctgaacgttgctcagtgcgaaccagtctacggtaatgttgttcagctgcacattggacatgaaactgatggtcaactcgtccaaggctacattttcaaagcgacacgtgtcacaattcaccatcgtgactcgatccatagtcaccgactctatgttcatgtttttacagtctcggaacgtgagcattccgggtccggtcaccttgctggcattggccgacaaacccttgatggtaaagggacgaccctcttcgtcgctattgatagccacagcttttgacattagaaaagagccggcttcgactaggcccacgtctccagtcttgagcaagtgtgtgataaaggcctcgatggcttcggtgtcgtccgtcacaccatcacccacagccttaaagtctcgctttagccacttttcgtgattgatctgaatagactttatcgccgtgttgatggtggatatgcgcgtattgaaacccatctcggtgtctagctttgctgccaaatccctaatattgttcaggttgcctagaaagtctagccggttgagtttctcctgaacctcgtctcgagagcgtacaacctctgccagtttgccctcgtactcgtcgcgttggtggtccagcgcatcggacagggacttgatgcgcttcgccaccgcaccgtcgtccattatgctgctgtcggtcaactgtttcttgtgctcttcgaatagcgcgcgtatggatcgagtctgtacgttgacctgttccagattggtgtcaatgtactcgtgcagtcggatcgtcaactgatcacccaaaatgctcggatccgtagactctttgagtttattaaacgacttttgcagattgttattctgctcgagtacattggccaaaacctgacaagcgtccacaagctttacgtgcaccgtttgcaactcttgtttcagcttgggtagttcggtcttgatcttttcattgacatctaccgtgaccgtggattgtagttcgtccagtttgacttgtagtttggacatgcgattgttaatgtcaatgtcggcgtgttgcaatatggaaacgtctcgatgcatctgtttgaggtgttcatcgttgtcatcgttggtggtcgactctctgtgttcttggaccagcttttgcagctcggcaaggatgctatcgcgctttgccaactctcggtgcacttcctcggcgttggcgtacgatgccaactctgacgattccacatagttggccagcctcgagccaaaatagttttccatgtcctcgtctttgtcggtcgcactgtgcatccttgcctgagtctgcacctcttgttcaatcttttgcaattgtgcacccaggtctagacacttgtcatcggaattcgagtaccatttactgtggtagtagagtaccatgagcccgttgactagtatcgccacgaccacggcgacaaatataaatgtgaaattcatgagctgtttcgatattacacacgcctcgctattgcatcgaaatgatttccctcaagcatatatacgcagttacaactaaacaccaataccgtattaagagtgtgtaccggtcaaacattacagactgtaattttttaaaaatgtttgccaatcgtcagtatagcgttgattctcacgagtcgatagactctttggtcaagtcaaagattgtctcctgcctgaccagggacatgctaaacgagatgttgctcgagcccgatcggttcggtgaagagtcctatttcaagtttctactggccatgtactgtaatctgtgcgaactcacaaccattgcatactatcccatagagtggcacgatcacgaacccatcatgcactacactagaaaggatcgcaccgtggtgcatctcttttccaagcctgtaatcattgatctcttcaagggcatcatcggttcgaatacgtgcaagtctaccgagttggccaacaccaatgtgcgcattaaacagattcatgtgattccaaacaatggaatcgccttggccgatgggatgccaactctaccgtcgcacattgccgataagctaatcttgctcacagtgattgccgatcacggcgcctggcactattacaacctgaagcgttcgcgcaacgccaaagagtaccgactcactgcgcatcaactcaatcggcacattagtctggcctcgttgatcacgtccagtcccgattcccaggtgcagaaacagacgaccgagtgtatgcatccgtgtttgataatcaagacttcaaacgtggactctgatgcaccggtcgtaaactgcaacaatggcaattcggaagacgatggagactatgaagatgatgacgatgaagatgagtgcaacgaaccgtttagcaccactcgcagaggcggtggttacattaaagataaaggctcctataaagatgccaacgactcgtcggcagttttgaattcaatcgttaccaaggattactatgataattagactgttgcgtgtatagagttgtaaactgaaccattattagcatgcaagcgcaaagtcataatcagcttgtaaacagaccataatcgtaaaccatccaccgtgaaagtattggcactttgtacacgtgcgagttgcgagcactaaaagtgtaggagttggtgcgttgccattaatgtaagggtaggcgtttgacttgaagactacttttgtagtgtatggtactagtgtccattaatcgagatttaaacaaaacaggtattgggatatcaattgaaagaggttggtatagttttataaacatttattatgtaaataaaattatcatgtaaaggtatttgtaaaattatggtattcaaaaaaatcacaatcgttgttggttagttgcttggtttgcttggttagcttagtttacttggtttgtaaaataaagttgattaaataactaaacattgttggcattgttattgttaaagtaagtaggtagattgcaagagctacaattgttgtagaaagttaaaattaagtaagtgcctacacgaaaagttttagcaatacacttgcaggatagttgccatcattgaatagaattgttgaaatacagtacagtctaaagatggagatatgtttaggtaggtttgtattttttaaccattaaaaatattatgctaattgagattctaaaaaactaaaacatactaatacaatctatgttaatacaatctatgcatacaatactaatataaaatcgttacactactacaaatttgttactagttttgctattagttaattagttagatactagagcttttggcaccacatttggcatcacaacaatgagttggtaagagttggtaaaaactaattacaaccatcggtatacatttataacaacatttctgtataaaatataaaagagttcatctataaagtttgttaagagttaccccagtttccatcaccgcgctaaattttaaacgtctacaaactctactttctccatgaagatccaccgctgctgggcttgtggtgccaaaagttcatcttgtggtgatacttgttctcggtgtagtcgcgcgtataagtctgcgtctctacactcctggttgcgggcttctgaacagtgtgctgaacttgttgcacagacggtgtggcactgtagccatttgtcgcactgctatagctcttgaacgcagtgccactgctaccgttactcgatccgtttcctccattgctattggtcagagtgatgcccgacttgtagaacgcacccgatccggaaccagagcttccaccgtagccagaagagccactgctactgccagtgttgtaagagttgtagctacccttgtagccagaattgccgtacttgttgtccttgtacatgtttgcagtaggtattctcaaatgtaataaacagcaagtgacactacacttcacaacaaggatgcaatatccactggctgaatcaccgatactgaattatatataaatatccactatggaattagtttgaatttcccgagtaggtagtagtgtttttatataaatgcaaatacacactctcggtatgggattcagaatattttaaaataactttaaaatatctggtataaatgctaaaggcaggtagtttttgtatacacgaccaaattttggcagatgtttacaaaatgaaggttcacaaccgaatgaccaaacctcgaacagaaccctccttaaatacccatcctatgaaaaaagtttcaaccaacaagcacgcacactatacaataaacgtatttttgataacacatttacgttattggcgataagtatgtgacattttatgtagaattgtactctgtttgaacaatgagttcgataatgaaaatgaactcgatccttcaattgttcgatgttcggtcgcctgtcgcgtttcatccttccaaactgaatccgattgtggactcgttgaatccagactatgaaaatgagcaggatcgcttgtacaaagcttaccagcctagtgttgtcgatgttgctcaattggacgatttcaaccgagtctacttggactcgttgaaaaagagtgcggtaaccactaaatctatatgcatcgacggcatgagcgcagtaggcaaatcctccattgccacccggctcgacggcaagatgctcaagccgggcagtggctctagattgatttcgcgcaactcgcatcccagctcgtgtatggcgtacgtgttcaattttatcaaagcaatgatcgaggcggacaagggtggctcggtgactctgtttgatcgtttgcctttcaacacgctcatgtggaacaagatttggctcatgctgggacgagccgaacgggagggtacgattgatgagaaacacatgtttaaatacaccgactacctggactcggacgttatcgaatccatggccatgttgtcgttcaacattatattggtggactcggatttcaaacgagccgcacaacgattgcgagcccgtgaagaaggctgcgatgtggaacgatcccagtggtggcactatatgccgattcaatactttgcatatgtggctctgcacgccagatggccgcatctcttttacctgatcgatttagagtccttcaagggtgaccagagtgcgatgcaagactatgtggtctcgctcataaaacgcatcgactgttttgcatccgagggccatgattcaatttacaagtttgaaccgatcgacatgtgcacgtacaccgatgccgagaccggtcaacgagtgccgtacgtgttgtgcggtgatgttaaacaggaaagattacgtccgctcatggacgtgagctttaccgatggcgtgaaacgattcacgctacgacaagatgactcggcacactttgtacgattccatctggttgagccgaacggagtcttgttcgaagtggtggacaagaatcgatgcaagcgctacaaactcaaacgcatcaacaatgggaaactctttgcatcggccaaggtgtgcgatcccataggtttgtggaatcaattggtagagttgagcgatggagtgttgatcaagaacagagtgctccgattcaaaaacaatcgtagtcgattcgagtttgttaaaatgttacagaaacgagtgtaatacaatgtaatataatataatgcaatataatgtaatgtactagcatgtaaagattaccaataaaaatctatccataaattctctcttgttttttagaatccaactagtctacttttttgcatccaagcatcccatcctaaacaaccggatcccttggactctaacctctggctctgagaattaatcaaatagatttacagactaattagccataggtagaggacttttgcatttccagaatccattagactcgttaggtttagagagagaattcattacatttgaccatttgcttgattagttcaattagtaaatttaccattagtaggcaataaacaagtaattgaagcaattgccagtattggtaatttgaatgcattagcatgtaaacatgtagtacactttgtaatccatgattcatgttttttagtatggtacaatgttaaactctcattgtattagaaacgccgtctagacttggtgtcaatcaaaaggcctacctacataaacacttcctgtctatacatattgtagctagatccgagggctttctaatgtcaatatctaacggtgaattctccatttcaatttaatacctacttctagttgaatgtaaacatcttttagaaactcggctttttccaataaaaaacaccttggctttatacaggctgtaagttgtaagctgttttttagattgaataaattacactgaattgtatatttacacttgttctttatgattttacgtagtcttgtaattttatacctttacaagtgcacctttataagaaggcttatagttttacgagtgcactgtacacttggttaattggctttgtttgcatttattatacgctcagcttttacacttggactcaggctcttgcacttgagttgtgattttgtttacatgctagagatttagtttgttgttgtagtagttgtagtagtagtggtagtgtgtattgaatgtaattcagtttacactttgtacaaggttactgggttagaagattgagggtagaaagagtggccgtgttggtaggtttgtattggttgtttgtgatggagagttgtttgtgatggggagttgtttggagattggtagttttaagatgggttatagaggcttgtttagagttggattcaacagaaacgagtacacttcttttaaactagaatagactttattcagcataaactacaacctattcaaaaaatatcaaacatcaagtaacattaacatcaagtaatatttatatcctttatagcagacctatgtataaagcacatcagtctttgactctacaatattcaaaatgtacatttattaaaaaatatcataaacacatttattcttgttataaatacatttagtattacttactatgacaatatttaccattacatacatttagtagtactatggatacatttagtgtaactcttagtttacagccatttacttgaacattaaacttgaacatcaagtttaaattatctcacaactttatagtattacaactagtattagataccaacattaaactatattgtacactatattaaacatttatattgttttgtgtttacatctatattaatacaccatattaaacatttatattgtacatattgtacacgtgcactctacacctatattgtacaattatattacaccaattttaccatgtttcaatttactatgcttcaatttacaatgcttcaatttactacacctcaatatattaccctacaatacactgcaatacactgcaatatacaacactacaaactgctacaaactaccaccaccccacacacatactaaactatccctatattgcaaaatacaaccatcaaatctagtgtttaacaaccactctgaaactaaactgaatccactaatattcactaatatccactaatatctactaatgtctacatagtccaacatttaacgagttcaaaatcagagtatcaccaccacctaatgtttaacacccatctgctccagctttatcttgacaaagtttatgaaatcgtcaacctctggtgtagacttgaacttgatcaaattcttgacaacattggccgtacgattcacatgtctactgtactctttcataatattgttccacacaaacttgaagctcttgtccaaccgagtgtgtacggccatctcaatgttgcccttcatctgattcagcttgttgtacacatagaaacccttacccattatgcagcccagagttttgccacatctacccttgcggtacactacaaggtagcgatcttcgctcttgaatcgtccgggtacagtctgtttggtgggtctgtatcggatgcgtctgttcttccgcagtctggtaaacggtccctgtggctcgtcgtccatctctacattcagtttggaatcggaatctgcttctgttgtaggctcagtgttggcatctactttgaaatctactctactggggatgctgctatggctattgctattgctactgctgctactgctactactactaccaacaacattagaatctacctctacaatattgtcaacacaagcctccttgagaggctctaacgggccctctagagattcctccattctgacaccctccaccaaagagccctccatttcgtccaagtgttcaattatagtgtttagattgacattgccactgcacggttgcataaagtcatcgtcgtcaatcgtaaacgccggcgatagactctttggcgagtccataaacgtagactcggattgaacctctgcgttaatgtactcgaacaagtcttccatgtcttgggccagattcaggcacggctctatgcaatcgtccacgttaatcttgtccaaatcgacatccttgcactcttcggtggcatcgaaaccaaacacttcgagcgcgtccaagtcttcggtttgtgtgcactgatcgacacggacaacggcgtccgtctgagttgtgcactcggacttgttagcggcacccatctcggtcgagccttgattcgcgactcccgagccgtctttgatgtatgccttctccatggcgagtacggcctccatcaatttctttatagtgtaatccctctgtttgattttacgcttgagtagtcgcgccaacccctggtagctaatgaattcattgtgaccgatcgacatgcgatgattcggaccgagtccctttatacgcagagagccaaacgcgtcggccaactctttgctattgaaccaatactggttgcggagtactagaggcatgatgtgtctacaaataaaactagacctcaaatgatgctctcaggtgctactagtggcttttattgcctggtattatctggtattatcactgtgaacaagtactataccgcacagcggtgtgtatcaaactgtacaactttatgaagttgccgatgttttataactaatagggtatgtgtgataaacccaagccgactttaccagttaatggttgttacaatacaaacgcaacatgctgagactattgaactctcaactgggcaagcgaggcgtagtcgacgatgcgctgtcccatagattactggaaaaatatccgactctgagcattcccaacgtagacttgaccaacagcgaacagtacctcgtcgagagaataattaacaatagacacttttacaatttatgtattgatggaatgtcttgctcgggaaagagtaccgttataaatcgtctaactaaagactattccgcctgcgcttacaagatcaacagcgagctcgagtgcaaagactacaatttcaattcgaccactgcgtttcagtatgcgctcaaacaggctctaaactacaaaaagatgaaacgatgcatcattgaccgatcgattctgtccaatttgacatttcagctagtctactggctcatgtcgtgcgaggactctatgtatgaaaagctgtcgccgcactgcctctgcgtaaactatatacgcatgcatcaaatggagccggtactagagtttatcaaggcccaaaaccacaatgtgttgattgtggtcaattccgactttgaaagagtctgccggatgatggtggctcgcggtgccggaggcgacgtctacaaggggctcgttcccaagtacgtagcgtctcaataccatgcatacatatttatggccaacgtgttggagttgcccgtgtttgatcatgcaagagtcgacagtggagtcgattcgtttgaacgattgtacaaaatcacatctaggatgttttcactgctaacgggtgacgatgacgatttcgatgccgagtttaatttgttggaaatgtcgaatgccaacaatggcaatgatgatgatgccaataatggtggtagtagcagtagtactggtactggagatggtaccagcgctagcattggatcattcagtacccccatcgccgacaagccttgcatcaaacgatccaaaccgacagaagaggaatggctcgatcgtctagtgtcgttgcagatgaataagcggtaggtgtagattccaatcaagtgtagtagtaaacaataaaatgtaataataagatgtaataataagatgtagcaataacatgaaattaaataaaatacatgtatgctttttgtaaataaattcaatttttttgtagacatgtatgctattggtgttatcatttgtggtattattgtaggtggaacactatataaataaattgccttgtccatttgcatttagttgcattctggttgccgtagaggtactttaagtagatttaaaatttacaagttgaagtaagaatttcttttagtgcacatacacacaggtacaacgttgcactacaaagtagacagcttagcgttcaagtggaaaataaatttacaactcgtagttgtaaaaattaattaacaactctaaaaaagagatagatacttactacaatgcagacaaactgggaagagcaccaatacttgaacacgatcagaagtatcattgaaactggcaatcgccgcatggatcgcaccaaagtgggtaccctgtctcactttggagtgatgcatcggtactcgttgagggacaacaacctacctctgttgacgaccaagactgtctttgtcaagggcgtcatcgaggagctcttgtggatgatttccggatcgaccaatgccaaagagctgagccgaaagggtgtacacatttggagcggcaacagtagtcgaagcgttttggattcgctcggcttcaccgacagacaagagggcgatctggggccagtgtacggattccagtggaggcactcgggcaccaagtatgtagactgcgagacagactattcgggtcagggtgttgatcaattgcagacaatcattgacactctcaagaccaatccaacagataggaggatcgtaatgtgctcatggaatcctgcagatttgcaccaaatggcactaccaccgtgtcactgtttggctcagttttactcgtacgatggcaaattgtcatgcttaatgtatcagaggagtgccgacatgggcctcggtgtaccctttaacattgcaagctattctatgttgacgcacatgattgctcacattaccggcctgaaagcgcacgagttcgtacacaccattggcgacgctcacgtgtatttaaatcacatcgagccattaaaggtgcaactcgaacgggagccgagaccttttcccaagctggagtttgctcgtaaagttgaaaatattgacagttttaagtacgaagattttataataaaaggttacgatccataccctaagattcccatggttctggctgtttagagagatatatatgatagatgtgttgttataggtgtccatctctagttgaacatgtagttggttgcagtgtttatacgagtaccaatgtaatctagttgtataattgaatctaatgtgttactctaatgtaatcctctaatgtattctttatatcacactctaataaatgttgttttttagtcaaacagagtctatacttttttcatcacctttatccatcaagttgtactctaccaaacctacctacactaaatgatattagggtaaccaacaaacccaacacacctacctccactaaatgatattagggtaaccaacaaacctacaccagagacagtctaaataaaagacgagacattgtaaattgtaaccatttattaaagcaaaatatgtaatgcaatataatacaaaataatgtcatacagtaaagttatagagcatataaaagttgaaagtggttgtacaagaatgtaagtgcagtttaaaacatctttaaaaaccatctttaatgttaatcctcttaaatagtaatcatagtaaccatgttaaatattaaaacactatccataatactaaacatcatcttgaacattaaccatcttaaataatcttaaataatcctaaataataaccatcttaaacatcttggatggtaaacatcttgtgtgctaaacattttgtgtgctaaacatcttaaatattaaatattaaacattaaatattaaatattaaacattaaatattaaatattaaacattaaatattaaacaacttaaatattaaactaaacatctttaatacaaagctaaacattctagacagtaaacagtaaacattaaagtagacagttataacactagacaggcttggaaatcttggacacaaaatgttggccatttattatttattatcaactatagattaattctgacttttagtacatacaagctaaacatttaattaaacatttatacattgagattccgtgtgctgatattgatgttgaacattattatagtgcattaaattttattctaaacatttacacgctacatttaaaatgctgtaaaatacaagtggctttaactacactaatgattacctttttaaagtgctccaaagtacttttaaaaattccaaacatttattggcttcatacatacaacctaccattagtgcctattaggtctgcgtttattaccaccactactactactagtggtagactttgttttggagcgaaaacgtttagatggaccaccaccgtacaaacgacccggcacctttttgatcattttagttgtaggaattttcacagttggaatagtatccattacaaagttgcgtctagtaactattggctccagcggtagcggttcaaactttacaagtattccattggccgacttggtggtcagaggattctcagtggtcgtctttttgggaataaccattattacactggactttgtactagtggatgtaggtagcactggagtgggtagagttggtaaagttttatcatttctcgagaggttcagatcgtctatagtttttatggaaccatttattggcttcaaaattacgggttgtaaaagtgtaaaatttaaaatggagctcaaagttggaggatggtttatagagttgtcaaaatgaaaagcatcgtcaaaatgaaaagtatcatttactggactcaatagtgtaacgtttgagtggctccgtgcaacctctggaggaaggattgttttcaatattgtcacatttggtgtgcgacgtggagctggctctataatttgaaggggtatttttgtagtagatttagactcggtcttggatacatttatagattcaagagtggtacctttggtgattgcatttgggatggtaacatgtttgtgattagcaacagatttgggtgtgactctagtgaccgattcaggctctgtagcagcctttgattcagttgtaaaatctgttacagtgcttgtttgaacagtgccaacacttgttgattgtacgagcacttttagtgtggagagtgcctttagtgtgccgtttgaaattgcttttagggtgctacttccgagtgtagtaaactgtttaaaaggtgttgtagttagatgtgttgtagttagaggtgttgtagttagaggtgtgggtgttgttttggttgttgttttggttgtttttgtagttgcatgatgattatgtaaagtagtggtagtaggaggtagagtagtatgtaaagtagtatgcagcgtagtatgtagagtagtaggcaaagtagtatgtagagtaggatgtaaagtactaaatttagagctgcaagtaggtttacaaacgacggataaatcctcaagcagagtggataatggaattggctttaaagttgtagtactaggtttaaaggttgtgagatttattgtggtcggtggttgtgtgagaggcggtgtaagaggttgtgtaagtagccgtgttgtagttgcaagtgtatgtttggttgttgtaggaggtttagttgtgagatgcttagttgtggtaggtttggttgtaggcatggtgctagcactggttgtatgtttaattgttgtatgtttaggcgttgtatgtttaattgttgtatgtttaggcgttgtatgtttaactgttgtatgtttatttagcagcgtcaataatggacccagagttggtaatatctctagcaatggcttcaaaggcttcagtgtaggcaaggtaggcaatggttttatagtaggtcttatagtaggcaatggttttatggtagggaatggcttaagagtaggcaacggcttcagtgttggtagggtatgtttaccgagagtaggcttgggtttcagtgtcgtagtaggtttgggagggttagttgtatgtttgggagggttaattgtaggcttagttgtaggtctgattgtaggtttagttgcatgcttggttgtagccttatgaagagatgttttaagagtagatctaatggtaggtttaagcgtagacttgatcgtaggcttgagtgtatacttgagagttgtcctaatagtgggtttgactgtagttttaagagtatatttgattgtagttttaagagtaggtttcagagtatgtttcagagtaggtttaagagtaggtatagtcggcctgggttttacagtagttttagccctcttcaaggtggtgtaaaatttaggctttactgtagtctgaatcctattctttaataatgtagtcgtcttttgtttcagtatggatgcagtggtgctagtaattttactacctatagatttggtagtattagtagtagcagtatgaatacgcttgccaaagtttgaatttaatccatccagtttggaatcattaatcgttttattgtccgtatttttagtgtttgtaccaacttggacagttatactggtagatttagcatgtgccttaccagtggatgtattagtctgtttaatgtcagttttagtattgggtagattgccattgacttttggaatagtgtcaactttggatttaaagtttataattggtctagtgtagattggtctagcgttgccagaaagtggtaaggtattgagtctcttaaagtttgaagttgcaacagtcctagtattatttagagcaactctgcgttgaccgtcaaaactatacgtttcctgatctctaacgttcaactgaaacttttcactacgcctactgaaatcgttttgttgcaccaaacgtttggcatctgctctgcctctattgctcctagtatttctagtgttgatgttgctcgtattgttgatgttgttcctagtagtactactaatattggtagcactatttacattaacctccccatcaacatcctctttcaaactacgcctgtatcgtctaaagattgcatgttcactgggttgtttgacgctgctagagtttgcaatcaaactactcatactgtttaaacctcccatgccatttagatttccacctaaactcgaatgcatactcttttgaatatcatccatgatcaagtttagtgttacttttgtataggtctgcaacaatctactaagacgtcggtgtagctttttaaagttggcctcgctgaaactggaaccggtatccggctttctagacaatctatcaataaaactaggcatcattctgtccataaaatttctatccataaaattggaaccgtttgcgtacagtagctctagataggatgcattgttatgattggtagcgttgaaagtatggttatgatttagtgtggcgctattgttattattattattaggattatttaaactgaaattaaaactattgttaaaactagtagcagtagagtccaaacctgcaaaagtaccagtttcggatccagtgtgcactacgccaccgttgcgataattgtttgcaataaaactagaatcgacatctttaaacttcaactcgtactcgaacgaatccatcaagagtatccgagtcattagcacgacgattgtaaacagcaccagaatcgcaatgagcgatgccacgattgatttgatgaacagcgacgatacctctctgcgtgcgatccattccttgcgagtagtagtcctctttagccagtcgacagcagacgccgccaccgacgatgtaagctccggcggtggcacccgagtctcctcctcctccgtttcggcaccgacagtgttcatcgcaggcgtcgacattgatattatcggagtgtggcactcggtcgtcgtctgattgcattcggtacacacaacgtctatgcactggacttgattgtcgtcgcacgagccaaaagttttaaacttgtaatacgacggaatgcgtttgctgcccagattgattcggtgcacattactactactagtgctaccagtactgcactcgtcgtcggaatttaaagttttggcaccagagtccatcctctgagagtgtaataaacttgataaaaaaacttggaaaaacttgagaaaaaacttgtactaataacaacaaaagcaactgctacggtatagtaattaattcaagagagagggtaaaaggaaaccccttcagtctcggcgtaaggctctctgtgaactgattcccacaggcgaccgctggcacttttaaagcgcggcaatgttaggtattttttagtcacacaggatgcactactaatactaacaataacaagtccaggatgtgatcagttgcagattacaaagagcacacgcgcgccgaacggttgctactagtgtattgaaggcgcgcgcgtgtctaaaacttggtaatcaaacaagtggccaacttgatcaaagcagcactatgaccggtacattagtaacggtccggtactattgttgcggggcgcgaccgtcagcacccttggtcgtgaacaaactgaaattcagaacactgttgtacatcactgtgtaagaattttattaaaagtcttgcatttatttaatcaactctgtttatgcaatgcagctacaatagcgtattgaaagtgtctaaaagtgcacattattgatgaatacacgatggcggtcgcattgtctagaaaacgaaagcgacaccaactcaaggatttaaacacatatttggaagtgaacgagccacgagtcgaaccgcagtcgtgcacgtacttttatgtaggcttcaacaagtaccaaattgtaacgtcaaacaatcccgtcgactatctgattgaatacatcaattcgtgtctgaccgatgtcataggctacattcgagaagagggctttgatctatgcaacaaggcaacgcattctcatatattgacacatttagtgtgcggtatactttcgtacaataaaattctaatgagcaacttttaccgatgcatcgtacacggtccgcttttgatggccgaagcggcaattctagtttatcgcatggataacagcgctgcgctatacgtgtccgatactatgctgcaagactatttggcatcggagagtaacacgactctattattcgattccaagtttgatcagagcgacatctcttcgaccacggtcgatgatattctgaaaaagattccactaaaagtaagcaaaccgagcaagatttacaatcagcaagaggacgcactgtacgacaactctgcgtgcgaggaacgcatacagcgcctgtttggtggaaaggtcgacgacgcaccaatcgcagagagcaagtttatcggcaccctgggcagctacacgggtacgtgccaaatggacgatatcgagtttaaggatcgtctcaccaaaaagaagcaaacctctatactgcacaaactgtttatattggccgatcatgcagttacccactttttggaaaatggaccgaatcactctgaggtgcgaagctttatcacgcactcgggattcggcaccaagaatgtgcaaacactgcactcttcgttgaaaattataggcaccgtttcgggtgttaatggtccgggattaatgggatccaccggaggattgtacggaaacggtctgctggccaacgatcacgttaccttgaattatgatgatggtaaattgttgttgtattaaagcaattgtataatttgaagaggaggcggagtagtctataattgcactagtaatttttagtaatttcagtaattggcgtttgatgaattatgcatgtggatacattgtagctacctaacggtgcacctagtctgatgtagtataatactcagtctgtagccgtgtatttgtatagaataaatatcaaggtatcaagtatcaagtatcaagcatcaagttttagattcattcagttggatttatactgttcaactttttgtattttttaaacctattgtatatgtattatatagttgtttcttcaattaataaaactaaataacaaaaataaaatacaataccccaaaccacccactttagtttaactctacaaacaattccataatccatataatttcatttgtgctccagttggcactctgtgtgatgaccggtactgtataatactgcagcgttaaactactcctaccactactattggttgttgcggatactactactactactactactacctactattattaaaactacaaaacacaaaaacagaaacacaaaaaacaaacacaaacaaaaaaacagaaaatacaactaaagcctaaaactagtatacctacatcatcatccttctctcgaaaactttaacaattccaagtttatcatttttagttttattaaaacttggaatgtctgcatgagactgtacaaaactatataaaactgtacaaacctgtataaggctatataaaattatagctataaaaaagtccacaccaaatgcaaaattaaatgctaagcaagtacaaaaattctagaaaaatgctagtttataaagtacaagagtcaaggttaacatatataataatatagcacatatgcacacataatatccttggtagtaaaacttttctctcaaaacaaaaggccatgtgtgtatgtgtatgtatgtaggttgattttatttttatttcagtctttaatacgagtacaattagtagcagtagaatgaacacaatttggtattgggtgctaggaaaacaataaatgacaatagatgaaaaggattacaaagattacaaagcttaaagactacaaatcaaacttaaactaaaacgccgactctccagattcatcattggtaaacttgataaatacatttaccaattcatttgttttgggatcgtactcgtgctgttgtttcaggtcacttatgtaatcgacaatcttttcactcatcgtaatcgaacagtgcttgccaatttcgtgctttaatctgcgcacatttatacggccgccctgtctgtactcaatctgaaatatggattttaaatcactccaagtgtcgtcgtcctttttgtacgaagcgctcttgttgctattgttggcgttgtttgtatagtgccctgtgccgcctatgccatagcacgaaccctcttcgtcttcgaaacctataccaatgtagcgcttcaagtgttcattgtaaaactgtttaaactgcatcctaaactcggacatgtacttggatagcgatatagtcttgttgtaggccgagttgtactcaatcagcttgagactgacattggccatgaggtcctcttcgttgatgctgggcaccgaggtggacgacatggccacattggactgagacggtgaaatcactttaatgttgcacatgtccagcaccttgtacagatagttgtttttcaacataaactcgtacaacagtttggtagagactcggttgatacactttggcgaaacgataccatagtcgttgcgatgctgtctaaagtagacgtacagcagattggagaggagtggtgccatcttggacacttccatttgctccttgtacgtatagttttcggcaaaggttagcatacaattgggatccttgaccacatcggtggccttcatctcaaacaggaatataatgattcgatctcggatggcctcatcgggcatggtcatgtacggcaagtgattgcacgctgccaccagaaaggtgcaactgctcaacatgggaaacttggtcgaaaacagggtacggtcatcgttggtgccatcgtcgcccgtcatcgttttgagcagattgttactgatcgagctcagttcattgatgatggaaatgtacttggtcttcaagtgtatggcattgggcgagggaccggatgactttacatccttgtactctttggaggttcgatagattgcatcgtcgttgcacatttcagtgtgcaagttgagcagtgtagttttaccacacctgggactgccgtagtaaatattcatatgtttttgcaccttgcacggctggtatagacagcacgtgtacataaagtagtctctcaaaacgtgctcgttgtacttgaacgtttccgagaggaaaacaaagagctctttgtagtgtttgaattcgggtcgacagtgacgaaacacgtacgaccatacacgatcccataggtttagcttgttcttaaagtgagcatcgtcttcggtgagatttgtgtatatttgcatcaaacgatcaacctcatcctgacggcccatgttgataaagttgaaggtggcatcgtccgaatctacaatggtttgactacaatcggttacgcatttactctgagaattgtttctactagagctgggactggcaccagtgtttggattggaattgaaacttttagatggagagttgcctctactggggggtttattgatattattgttaatatttgtattacttttatttttagattgaaaattgtttatattggcatcattatcattatacccatcctcatccattccctcataatcctcagattctccaaaaccagtcatgtcgagatcgtgcaactctaccagactaacattacccttgatgatgccgatacccttgccagactgttcgaaacctacaacgttaccattggccgcaaacaagactgatcgttccggatgcaatagggaaaagcacaagactcgtgcgttttcgtgaacctgacccagttcggcatcggactgtaccggtatgggatcgtccatgatcgaacccatcagcgtcagtagaatgcaagcattcgccacgatgatgggctcttcggtaatgtcagtgttggtgtcaaacgacaagcgttcgtagcactctttgaccgtgtcatacgagagctcagtgtcgtaggcctccaacagggccgagatcatacgagccaatgccatggtgtgaccctttagtttggccaacagtgggtgcacgaaaaagtagcaacgctcgttgcgcatagagtcaccctccatgaaatgaaagatggtcaaccatgcccgttcggctagatggtgcgagtagatgctatactccatggttagcaaaccgggcagcatccgagtcaggtagaacaagagacgttgattctttagaaaggtatccaacagacgatagtagtcatcgtacgtctttagcaattgaaagttcataatgtttaaatctttggatccgctcagagtgtgggcacagaagcgcttctccatgttaaagtagagaaacggagtcttgggcagataggtgccggtgattgtgtaaaagactccgtgactagtgttgataaagtaggtgtactcgttgaagcgcatctgtcggttctttagattggcaatgatggtggtgcacgcaatgtccttttctcccttggacatggtgtcaccgatgcccagcaacgactgaatcagacgcaccgtattgcactgtttcagctgggtcacttgttcgtaggccttgttggtgtaattgtaaatgtagcagtcttctccgaaatccatctttatgggaaaacaaattagctttatgattacctcaaaggcctccacactgggaccctctacggcgcccagactaaagacatggttcatcacggccgatacgtactcttgcatagtgttcttttgctttatggaaatctccaagattatatagtctagcagatcgttgtaggtcaacgcaaacgatctggagagttcgttcataatcttgtatcggcgcatgctcttgatgatttcaatcagagactcggtgtgaccgtctcgggagaggaacgtgctcaaatagtcgagtacatcattcttgatggtctcgtcgtcctcggaggacatgctgtcgttgcaacagtacatgatggccacgatcaacaggtacaccgagtactcttcgttttcaatcagagcactgattaggtaggccacgttctctgcgttgggatcatcgcactgcgcaaagtacaaactctcggccaggtagcgattgagcgagaccagcgattgctgtatcggtctgaaacgttcgtccaccgtgtccgtatcgagcagagttacgctattctttagacgcaactcgttgcgcatagtcaccacgaaatccaacaactggtacgtggactgtacgcttttgatcgattccagctttagccgacaaatggtgtccaacagggtgggatgttgcctgacttggataatcttgttgttgcccacatcgggcagtaccaagtacacgtaattgtgcttgtctatagacttgagcgttacggtaatcttcatcggtttggcctcgtactcgagcagcggtcgactgttggcacccatcgtggtgcgttgctgataccaagagtagtcgtaaaagtattcactcttgccaaaggaaatgtacatgtaagaggaggttgatgtagagtttgcattcaaagtgcctgccggtattgttagaacagtgttgtcgttgtggttagttgcggttgtataaacagtaggcgtatttgtagaatggttacaagtattaggattattaggaacaattggtaaaacattgagatttacatcaataatagtggtagtagcattgttggtagtaacattgttggtagtagcagcagcactagcagcaggaacactagtagtaacaacatcagtaacagtagcattattgttatcattattattattttgcatattattatttttaatattagtagtaaaagtagtagaggtagtagtagcagtagtcgtagcatcactagcagctcttttagatttagacttgggtttgggtttagctgcggccaagtgctcgttgtcgctgcaacccggtggtatgcgcatcgtgtaaacgttgccgtcgctctttgccgagtacggtaacggcaccttgtcaatcttgtcaatcttgtacacgtccgtgtacattggtggcagttgacagtttagcacatcaatcatggtatcatagagtatgatgctgacatccacattgtagtaaatgtgaacgtttcggtttctggtcattacgaagccgttacgctcacatataccgagtccgggaaagctagcgtccaagactcgtgtaaagtctcggtacatcatcgtcagctgggtaatgggaatctcttcgataccgtcatcgtccgagggcttcaagtctagatcgaagcaaatcttaaactgataattgtggctcattggtatggccagagtgtggccagactcttcaaagtagtcacgcaacgtgtccagccggagggcatcgttgcgcactcggaccacttcaccgtttaggcaatcgtacaggcgaaccgaaaaagagtcagtctcctcggcccgattgcactggaggaaccttgtctgatttctggcaatatcttggcagtatgcgctattgtagttgtgatcgtagtctatttgggactcttgcaaaatcactgtaggcgtaggttcatagacaagagaagagtacattttgaatctgggcctcttgttgttgttattacccttgtcatcgttggacttttcatcgttggcaaaacgtttcataatgatcggtactatcggtaaatactttgacaagtaccaagtgtttatagtattaggtattgcgataattgcaatagtctatacgttcagtttgttaaaaacatcaaatctcggcaagactatgggctcactcaccgatgaggccaccgactctacaaagtttaacgcatccttctttgagatttacgacaaatccaccgacgactactgtgatcgtctaattctggtgcaaccgttcaattggataattgtggccaaaggtggccagatgtacgccctgaccgatgtgcagcacaagtgtccgccgaccaccacgcgtgccgtcaaactgcactcgaaccaggacaagttcaagtatgtgtgcctgtcgttgaccaagatgcagctgattgagctgtatcgcaatacggcccacaatgtgctcaagcttacgttcgacgtggacgctctgcaatcggacgagaagaggttcaccattttggatgcatgcaactacctgctggcacagggctacgcagtattggacgtaaaggagggtgaaaaggtggacaacaccaaagcgactaaaccctcggacaaggatgtcgaggacgatgctagattcagcattctaaacatgttgcgtggacagaatggcggtacggatagtggcatcaagagtgtagttattcgtgacggtagcgatgcgagaggtggtttgggagacagtgttggtggtagcttaggaggcagtgttggtggtgtaggaggaggtagtttgggaggtagtttgggaggcagtgtaggaggcagtttagaaggtagtttaggaggtaaagagcaatctaaattagacgatgattccaactccaagattgcaagcattattataccttctgatgctaatattgactctgtttctaatactgagattccctctgttactaatactaagagtgccactgtttcgaatactaatgttgcctctgtttccaatactgacattccctctgtttcgaatgctgatgttgcctctatttcttatccatctggttctaatattgcctctatttctaagactgatattgcctctgtttccaatacatctagttctgatattgaatctggttccaatactaattccaagattgttactgacgctaaatctaatgataaatccaaagacaaaaccaataacaaatccactgacacatccaaagaccaatccaaagacaaacccaaagacacgaccgattccaatattgatgataaatctgattccgagtccaataccgaatatccaatcaaggtgattgaaattacacaaccaccaccagagaatgtggacactacaaagctagactatagcctactgccaccaccgaaacccattgaagtaacgtacattgatttgagtaaggagcctgaatctactggagattccacactacagccaacacaaccacctcctcgtacaccgacgccaccttctacaccaccgcctcctcctacaccgacgccaccttctacaccaccgcctcctcgtacaccgacgccaccttctacgccaccgtttgttcctacatacaatccacccggaggtgtggtagagtacgatggagctgccgatttccttgagctgctcgatgaggacgatgcagactttgaagctataaaatcaaaatccaactctcgcaaaaggcgcgatctgtctacacagtccaatgatggtgatggtgatgatctaccgccgttcataatcgatccggtcaccggcatcagacgtcgcaaagtgaccaaactgcccaagccgctagaggttgcagcgcccgagtttcgagactttgccgaggagaatttcgatcatgtagagctacccaagggctttgaactaccgctcggagtgagtctcaaattggccaagcgttggcagcaaattctaaactactaccaggacaatggaatgccaactcacagagcgcaagatgcctacgacatgagcgatgccgagtgtagagcaatgggcaaggctctggcgggctactaccatcgcagccacgacccatctaaaccgcccaagtttgggccaccaccgaatccagagattgactctttggtttacaaaacgtattagtttatggagtggcttgtgtttaagtttctaattctaattctaatttatataattcctttaatttctagttttgtatccattttgcatgccttgtgtaccactttatgtaccactttatgtaccatttttgtgttttttgaaatgtctttgtattaacaaatttaatagccattataatatttcaccttttttaatcaaaacccaaataagagtacccaaaaaaataactagtctagtttgtataatcgtttattagagagattcaaagagtatgtatacagcgtttaagagatttaaagagtatgtagacatggttaagagattcaaagagtacatagacagaggtttccaagattaaagagcacgtaggccgagttacatagattaaaagagtatatagttacagagtattgaattagagtttcagagtattgctatttcagagtagagaacatgtatatcgagatcctttcataatacaggtttactttgagattcataatacaagcttactttgagattcacaagagattcataatacaggtttactttgagattcataatacaggtttgctttgagattcataatacaggtttgctttgagattcataatacaggtttgctttgagattcataatacaggttattttacaaacacaagatattcccacactaaacatcctcatcctccaccccccctatgccatcgaaaacaaatgagtaacagtctgggactctttatagtcaaactcacgatcagtcaaaacattgagcagcttggctagcacctccaattgatcgcgcttcaccagctttggcatcgatcgtagattcttcttgtctgcattgcacttgatgcaaatattgctgacggtaatctcttcgtcgccggacctggtctgttgctctatagtcttgaagacgtgatcgcaatcaatgtcaatggtgggaatctcgtcgggcctcttttccagaaaacatcccagactatagtgattgtcgtacactttgccggtgtgagtcctaaagtagactcgctgcgtgtccggatcacgataggtcatgcacaacttttcaaactttacacgagaaccctccttttcgattcgagtcttgaatcgttcagtgggcaggctaatctcattggtttcgcgttccttttgtagagactcgtgaatcgctacaacactgggatccgatgtcgtaaacgagtacagcactgtagagttgctagtattcaaagagagtctaatgttgacaatcttaaaattggtcttgtactttcggtaggcatccaaagaggccaaccgatacagtgaactattgatggtctcgctattgagcaagtttgaatctatgctaaaatgatcctccagctcgtacacattgagcggattattgtgctgtttttgttcagattgcatcttatcagcaaatgttgatttccgctctaaaagtacacaaccgctctcgtacacttgcaaaatgcaaatgataccgtgctttgaagggcttcagcttttatctggccacgggtggttgtttttttcaacctctctacttgctacatttgagctttacaccaataggatatacgctattgaaattgtttagaaacgttgatggagttattgcgtgtctggggtacgagtccatttcgtagagagtgagactagtagcctatagattcagtccaggtaaaatgccatccaccaccaacactagtcgtaaaacccctaaaccagcatcaaagcgattctccactggcaattttaccaattgggattctccgaatagtggcatcgttaggcttctctccgatgccaagtgcagggtggaatcctacaaagagctgcctcatcgcaaatacaaccagtgcgactacaaacgatggatgtcgcactaccaaccgatgcagtatcgctaccgatgctacctggacattgagcccaccggcaagatgtacgctctcgagtgcggagtcgaagccgtgcccggtatacgggatctgaccgtgctagtggtggactcgacagtggcacaactcaccgacgagcacattcgaagcgtgtacgagcagctcgaagagggtctcgacatacgaaccgattccatctatgctcgatgcgtcaagagtgtacgcacagatttgcacttgcaagtgtttgacgagctgcattcgaggttcggttcgagcatactctacattgcccacaacgggttccagtacgatttcaaaatcatcctggacctgttgaggcgcaacgatcgagcctactggagcgacatggccttctcagactcgttggtcatgatgaagaatcgcaagggtgacgctaaaatctctagctacaccaacagtgctctgttcaagatgattcagagcgactggcaaaactactatctgctgacaaagatgcactcgtccattggagatgtgctcatgatggccatctggacgacgagtctaggggtttacgaggcgggcagtcgagtcgcagtgtgcaccggtgcacgtttgtgcgacgtctacaaaaaggcggtggctgtgcgcaaaccctccagactcgtcatacgcaatccctttgacaaacgctaatctattgtttttcgaatgcataactcgtacacggtgttgtcggtatctatactggtcagtttagtgatatgcacattgccaaatcatgtttctcaatcccatcacttttggctacaggacgggtgcgcagcacgatcctctgcaggatcggtactcgttcaacgtgtaccgtgaacgcaccaagggtcaggtcagtgtagacgccgacaactacctcttcaagtctacttatttttggatcgcaccgtacatgatcaataagcatgcgactccggtaaactttacctttaccgaccgacgacccgagactacaaacgcactcggcagcgtaaagagttctcaaatcggtccagtgttacaaccgcaacagcaccaccaccaacaacaacaacctactcagggacagggtccggctcaggcgctctttgacggcatcggcacttcggacaatgcgatgggatcgattcgtatagtgggacgcaaggcgccggtggtggtgtttcgcgatgtgatcgatttccgagtagacgatcccggcacaatgtccatggccgactatatgcaactaaagcaatcgctggaacgtttgaattcactcatccgagacacggacaacgtggtcgacacggctgccgaagaggagcgcatgagggccaccctctaccggttcgccagagagtctagtgtggcgagaaacgaacgcgaatggatacgagtgctaaacgccaactatccagaggcgatggccagactcaacatgtacggtactgggggaatgttgaatagtgacgatatgcaggtagaggttgataatgcaattgacgagtatgatgcttaggttgtggattattgtagtgttagtttttactagtggatgagtttgtacgagtagatgtccttagtttatatttgtactagtagtcttgtaaaattatgtgtagtagatttgtaatgattgcttgtatttttttaaaacacctcttgtcttttttggaaccactcttgtaatttaaaacacctcttgtcttttttggaacccccccccctacatttccatttttcaccaacattcaatgctagtatactcgcaacactcgagtgtggcctcagaggtatgctctcaaacgcctaccgtgcaaacaatagcaagagtacgggttgcgtgaattttcaacatttgcgtgtgttttgcgcattttcatttttatagagtttgtgcactatagagccaatacggtattggggttatattgtggtgcaagtattatgcggacgggctcatttgaccgtctccgtgatgggtgtgcattttgcacggtacggtgaggtgtagtgatgtgcatgaaatgtgcgcaaaactacactctgtgacatgccgtaatgtgtaaaatgcaccctattgtgaaccccttcggttcaagttttagttcatactttttaaactcgtaattttaacacgaaattgggtacaatttcacgcaatttcagtgcaatttcacgtacatttggtgtgtttgctctgtaaattacgttaggcgttggctaatctggcttaaaacttggtcagaaaatcatcaaatatcaccgagtgtgcagatggctcattttgagcactttgcgcactttggtggtaaaatcgacttttgacttgcgtgctgtcctgtttcgcacaggcatgcaaaaacagcgtttttagggcttttgaagatgatactgtagacggtggttttgtgcacttttgacgactttgggtgcaattgctatagcagtaattgcagccatttgtcgtacaagatgcaacaaaagtatcgtactatagtattatttgggggggatactatactataatatatattatatatataggtactgggcgccgagttctatttttttcaactcgtttttgttatatttttttaaactcgattactgaattttaaataatactaaaaaatgtaaatgtttctatgtatttatttggtagaataatggtggttacaagtatgtcttacagttaccagtatggcttacggttacaagtatgtgttacagctacatctacaaacatttcttacatctacaagtatacgcacatgcaacaatatacaatagcatgcaacaacatacatcaacatacaacaacaatccccccataaaatctaaatctatcccttgagcttaaacacacatccaatcataagatccaactcgtgcatggcctcctccacttcggcacgcgtagacggagtcagccgatcggtgcgtctgcgcagaaacgtcaactgattgcacatgctgctggtgccggcttgcaggttgtcaaacgacacctcatagatgccatccggcatattgtcatagtgaatcagattcagcgaatcgtccatgttgttgctattctttacgtacaccatgccgttcatgagcttcacatcaaaggtgggaaacttgaacttgaactctttgttgcgataaatgacaatgagtccgtctcgcttaaacttggtggttgcgttcacgtctatggactcttgcaccaggatgcgtttacagccatcgccaaagtttacatactgctgttgacgattgaacgtggacagaaacttgagcacctcttcgggttcgggcataaacagttgaccgccgagacgcactcccagcacgtctgtgattatcactgtgggtatgccctcggatgaggattgcgattcctttctgccgttggtgcacatgttctccaattgaaagtacaggttgggtacagtgttgaagattgacgaattaaactgtataaacttgatgttgtcatcctgatagagaaccttgttgggctcggtgcacaccagtttacacttgaagccatcgtacttgtgcttgtagatgaagctcttactgtcgcgtatctgcaccttgtgaaacttggaaaagactcgacacggcatcttgaagacggaatcgtgcgtggccggttgcaatcggtgcagtacgcacattatgtttgacaccacattggaggcaaagtactggcccagagtgtctctgagttcgcacaccagtgccgcttcttgcatgcgcagtccgtgaaaatcattgagcacgtctagcgtgtactctacctcgcccgatatgtagtactcgttgccggatccgttgctcctgcactctagactgatgcgaatattgttgttgcgaaacagcacaaacctttgcaccatcgacgagagatcgctcatggatgccgtaaacggcacattctcctctatcgatacggtacgacacatgggaatcacaatcggtgtggccatcgtgccgctcaggtacaagtgtcgggatttggagattacgtgtttgcgctgagatgtggtgccggtgactcgagtgttgtccttaaagtacatgacccacacttcacgatgtggcaagtctacgcgtgcaatgttctttttgatgcactcgccaatgtgagtggagactggtagtgcaaagtaggtttcgtactccatctcacaattgggattgttctcggccatggatgcaatgtgtgccagagtcttttgattgggagtttggttttgcttttgattttgatgttgcttttgagtttgattctgaggttgattttgatgttgcttttgagtttgattctgaggttgattttgatgttgcttttgagtttgattctgagtggatttggaatcctgagttggaggttgttgagctagactcggcttggactctttgggttgtggctgcttttgcttgggctctttacaatcctttttagccatctcggtattggatgcactcttgttctttacacttgatgcagagtgcgcactcttggcattattattggactcgatgcccgagcttgtactctttgtgtttgaattcaaactgtttgaatttaaacttgaactctttccactgttggcactctgtgtactaatggtactctttccactttgcacactctgtccactaatggtattctttccactctgtccattattagcactcggtgtactcttgccactaccattactaccaatactgctggtagcactctttgcgctaatgttgctcttggtactatttgcactaatgttacttttggtgctctttgcactaccaccactaccactactacctgcactctttacactgccactgctaacactactctttggactagcgctaccggcgcctacactcttttcattgctactctttacacttgtactagttgcactatccggactcccatcctgtggactctttacgccatcctgtgtgctcgttggactctttaaaccggcactctttgcactagattcaatcgcactcttgattagtgcattcttttgatttatactcttttgatgcagaggactcttttgatgaggtgatgtactcttttgggatgtactcttttgggatgtactcttttgtacactactcttgtgtataccactcttttgtaaagtactcttttgaatcgcgatactctttggattcagtaaactcttttgacttggaggattcagagcagaaccggtactctttaaagtgctactattggtactctttgaactcggctgcacaggcttgggaatctccgagtcctcatcggtggacgattgagtgctatcgaatcgtttaccgaacccgttgccatcgccgaatcctaccgagttgaaattgttgactctcttggcggcaggatgcgcatctgcgtacgcatcctccgaactcgatgacattgaaaagttggcagacctcttcatgatcgctgccggaagtgtactaaaaaataactagaccacctactgaattaaatactttttctaaaccctgaatacgtgcgtgtagtatcacgtacaatgcaataataaatgtgcacaatgataatttcaaaacatgtaaactacatttgtttagtaggtgtttagttttatatcctcaagataagactggtagctatgagtaagtgtattgtacaattggaggacaaggtcgagtgtaatcaaaactcataacgagttgctaaaaaaatagcctttattgttggtattcaatagattacagaattgaaaggttacagagtacaatggtacatttttgtctaaggattgttacaaagttgactctaaatctatactctaaactaaactctaaatctatactctaaatctatactctaaaccacactttgttcaatcttgaccctctttgcagcggattccccatcgagtccatcgtcctctgccagaacagcctttacgtcaagtttgcgcttttgacaagttccactctcgagctcctccaagcatctcgtttccatcatctttttgcgaatgtcgtccatgggaggacgagggtgagtacgcaacagcttcttgtactcgtcatagttggggtttccgcgatcgattccaccaaagtcaccgatgcccttaaagtcacgctgcaccagttcaaagttgccaacaatcaccttgggtatgaatccgttgagcgatagcgagttggcggacggagtctttctatagtagttgtttccgatgaattgatcaccgttcaggatggatctttgcctagagaacggcaacactccactgggaatcttgtccagtgttttacagttgctaatcttccacaggttacgatcaaaggtggagagatcgcgacgacagcccatgtgcacgggacgcaactctttggccaccttgggtgcatcggccggcttggtgtgggcactcattgcggtacgatcaaccattatgagtttaatcttgagatcgatgctgaggtgtgagtcttgtttctcggcatcgttcaagtctctgagtttggcgatgacaacaccaaactctccggcattgtgagtgtccaatgcgaacggagacacgatgattggtgcatcgtcggtcgcctggtctgtgatcacgatgcacgtactcggcaccgtgatgaacacaccggacaatacgactccgcactggtagagtttcatcgagtctacaaacgcagaaggcactcgcaaagtcagagtatcgctatccttggccgtcagcagagcctcatagggacggtccactagacgattcacaaacacggacaccttggatttaccctttttggtcttgatgcccttgaggagcttcttgtagtagtctttgcatttctgaatgctgcactccgagtctacgttcaacaaagtcttgaaagtgcaagaagccattttttattacaagtgtttgagtagtctcagttattaaagcaaagctttacaatgctcgaatctatagaatatcaccgccttttaaggacaataccgtattatcgatatgtttacgtttgaatgttatataaaacactttgcgcgtacggtgtcgatacagtctgccattgttatttgtagtgcaaacacactagtggtagagctatacctatactttagcacgacacctacttcatctacatttgcctactctttacctactctttgcatacttttactaccggtacctacatttaccaaccatgaaacgtagtggagtacacaccattgaaaatgtcaattttggcatgtttaagcgtcctcgtacgatcaagggcgactttgagacggattggtgtgtgctcaaatttaggacctacaaatcggtggcgtgcaatgacttggatcgaaactatatacagtacaagagtcaggtgcactgcataatcaacgagtttaaaaaggaactctttctcaacaaggttattgaagagtacaccgactatgcactcagccgggctctggacgattcatcgacgttggccaagctcaagggtggacaaaaggtggtaatcgacaatgcaccgaatcgcgatgccactctgcgcaatctgagatgctgccaccgattcaacaatggcgtttgcgcacagtgcaagatgacccccgaagaggccgaggcatcgtttgtgtctctcaaagagtgcctgtacgttaccaaggatttacgcactctggactcgtacaagcgactcgaagccgaaatggaacacaatgccattaggattcaagaggattgtaaaaagattaaactctctcaggaggatgaatcgattgcacaaaagtacacggatgacattcgtgcgtacatgagacactttaagaatcgcactctgctcgagtacctgtgcaatcgcgagtgtaggagttttttgatgatccactatcgagccgagttggactacatcatgagagtgtaccagtttttgagcagcatcaatggtgcgaatcgtttacgagtctacaacaatccccagcctgaggaggcggagggtgacaaggccaaacgcaacaaatccaacaagatggaccatcgcatcagacaaagctacaagcacatgatttactattcaaagaagaacaacaagagttgcctgcatcgattgctcttgtcgtgcaagcgtgaagaggtcaagggtttgttggattttctacacgacaccaaaccgatgaactctctgtacatgcacacgcagatttggtcgagcttcatgaacggtctaaacattaccaagaatgaaaagacctttaaagagtacatgaaggcgtacatgcatcgcagatcgttggtcaaaaacatttaccaaactctgaccgatatgaatatggtgccggccaagagcggtttcgtgtacgatctcatgttggacaatcgcggctatagttcggtaaagatttgcatcaaacgcggcgtgcacatgctctcggtgaacggatcctactatcgagagtttagggatctctacaatacggacgttgacgagttggagggagtgcacgtggaacgtacacccatcatgatgaacaagtacggtccggtgattacgacgggaggctctagagcgctgaaatcgtacaacgtggctcgctcctacaagagtctgtttgcccaaaacactaccggcaacttttacaaaaagacgatcgattactatgtacccgctagtgaggtgtaagccaatgtgtttgtgtatgcatgtattgtattgtattgtattgttaagattttaattaaaattactctatattttgtaatttaattcatgtaaacctgatgttgttttattaaataaatccacttgaacacaatgcgtttagtcttttttcagatgatgtattagatacaatacggtattggtatttgtctttgggtaattattaaagccttagctagtttagcttgaaaatgagtcagaatcctagaatgattgtcaaaagaaacggttcagttgaacgattcgatccatctaaattgtacgctaggatagaaagatgcatgaccatgtccgagccccgattgaccaccgcctttatcaacattgcaggcatcgtggccgatgtcgaaaagggcctgtacgatcgagtctcgacattggagctggacactctattgtccgaaacttgcgcctccatgtccaccgcgcatccggaccattcgatactcgctgctcgcatagccatgcaggcgctacacaaacgtactcgttccaagttttccgaaacgattcgagacttgtacgaggccaacattgtgccccagtactattttgacttggtacaagagcatgcagacaccttggactcggccattgtagacgatcgcgattttcaatctttgacctattttgcatacaagacgctagagcgtacctatctgataaagctggccgacggtaagatttgtgaacgagtgcagcacatgtacatgaggaccgcgctcggtattcacggtcgggatattgaatcggtaatcgaaacgtacaatctactctcgaaccgctactatgtacattcgacgcctactctgtgtcatgcggcaacgaatcgttccaactatgcctcttgctatctgctcgaactcaaagaggacagcatcggtggcgttatggacacgctaaaggacgcggccaccatttcaaaacactgtggcggtgtaggtttgcatgtgcacaagttgcgctgtaaaaactctacgattcattcaacaaacggcaacgccagtggcctagtgccaatgctcagaatgtacaatgcaatgtcacgatacgttacacagggcggcaataaacggccaggcgctatagccgtctacttggaaccttggcacgcggacgtttttgactttatcgagatgcgcaaaaactctggctttgaagaggcacgagccagggacttgttttatgcactctgggtgccagatttgttcatgaagcgcgtcaacgacggtggctactggagcctaatgtgccccgactcgtcacccggtctgtccgattgctggggcgaagagtttgaggccaagtacacggcctacgagcaagagggccgatacgtgagacgagtcgatgcacgagaactgtggaaggccatcgtgacggctcaggtagagactggaactccgtacattctctacaaggataccgtgaatcgcaacagcaaccaacgccacttgggcaccatcaagggctccaatctgtgcacggaaattgtagagtacgcctctccggacgagacggcagtttgcgttctggcatcggtcaatctgcccaagtttgtagagggtaaagtgtttaatctcaacctattggcaaagacggtgcgtctggtgactaggaatctaaacaagattatcgacaatgcactctatcccattccctcggctgccaagtcaaactttaagcaccgacccatcggtataggagtgcaaggctacgcagacgctctggccatgatgggtatagcctacgaggactcgatgcagttgaatcgtgacattttcgaaaccatctaccatgcagcactgacggagagttgccaactggccagagtgcacggagtctacgaatcgtaccacggtagcccgaccagtcgtggagagttgcacttcgaccgatactcggtgcacagccaaaagtgtgactggtcatcgttgcgcaaagacattgctcggtacggtttgagaaactctttgctggtggcaccgatgcccacggctaccacttcccaagtgtttggcaatgctgaatcttttgaaccgttcacgtcaaacatgtaccagagacgcacccagtctggagagtttcaattgaccaacgtgcacttggttcgagacttggaacggctcaatctgtggaacgatgacatggcccagttgatcatgtacaacaatgggtccattcaaaacattaccatcatcccggaagagttgcgcagaatctacaagactgtctgggagattccgaccaagacgctgatcgatatggctgccgacagaggtgtctacattgaccagagtcaatcgttcaatctgtacgttgccgagcccacctacagtcgtatgacttcgatacacttttacgcatggaacaagggcctcaagacgggcatgtactatctgagaacaaagtcggccaccaatgccataccatttacggtggacgtgaatcgttgtgccttgttgatgagtcaaatgaaggctggcagggttatggcttcaccgtttaccaagtctttgttggtggttgagggtagtagtggtggtgttgagagtactactactggtagcaatactagtaacagtactactagtagcagtactagtagtagcaatcctagtagcactcctagtagcactggaacaaagcgcaaccttagtcgtaccatgcgctctaaacgttcactgcatcacattacgtttatgcaacagattgcagagaatccaaccaaggcgccactaaaggctaaaattgatgcagcaaattctgttgagaatttaagtaaacgcaaagagccttcctttgagttggtcgatagtgatgctaaaaagatttgcatggatattgatgataaatcaaaggatgatgaaaacaattctcaaatgtgtcaactagagccaaagccaacagaggtaaacgaatcaatagagccaaaggaatcaatagagttgactgggcgcaatcaaatggtttgttttgatgatgtgtgtacgtcgtgttcttgttagaaaggttttgtaatttgtagagttggtttatatggttgtagagtttagtagtttaaaaaacatttaaaaacatttaaaaccagttaaaaattgttatgtttaaaaaatatacatgaattgtttagttgatggatatacatacagggttaattataaggtagatgattgtacaagtggtttgtgtacatgtagtacttgtaaggtattttataaggcattctataaggatgtagacatttaaacaatctatgcttgtaataaattgtttaataaacttgtttaataaacttgtttaataaaaactaaaatacttgttgttttttagactctgattcaatccaattcaattcaatacaataccatgcaatacacctccctccccccatcaaaacccagtcacaatataggtaatcttgctgaccacgttcgatagagcacaagcatcgtgaaacttttcaatcttggatcccaacacttgactcttgttggtgtctagaattataacgttatagtgttgttgttgctgagtggttttgattagtttcttgatggtcgtgcccagagtacggtagccattgttggatggatacattctaatgtacatggacgacggacacagtttggtacgttcgggcacattggaaacgtgcaagagtatggtgtcggtgcacttgcgtgcatgtcttagcgcaatagtagcgatgctcttcacgttgtccggcttgacaaactctaggtccataggcatgatgattaatggcacatttcataatggcaaccttggactattgtaataacacattgtcactatcgtgctaacggaaacgtttggtgccatgaaacgacttgagccgtattcagtatataattggaaaattgcaaggtatagtattttacaaaaacaatggacaattgtaaagatgtcgtaaatgccaggagtcatctgtacaacaacgaaggcaacagtctcagaccgtactactatctgtttgagcgcagcgatgaacgcggtctctttaggttaaggttaaactacaaatatcacaagattcgtcaaaagcattacataaggttcaccaaacagagccgaggcttcagcaacgagtacattagtcaatccaacttaatgtccctattcaagattgccatgtttgaatttctaggtagatacattgtaaacgtaggcagcatagtttcaatcaatcgtaaacgcatacagtctacgaccgtggacctgggggagcaagacgattgcggtcacgtctggtatcagggattcatgtattccggctatgaaacagtttacgatccgctaatgtcgctgcctcagtcgtcggagcccacttggatttccgattgtgcaccaatcgtaaaaatcgttcattcgttgccggagagtgtcaacattttgagtttttgcaagtttgtaagaagcgtcctattcgacgaggatgacgacgccatcatagcaatgaattacccaatagttagaatggttcaaatcaccaatgagatattgcgggtatacaatctaattagaataaagggtaacttgaacgaatctttagagtatctaaacgcgtcaataacgcccactttgtacgatctagagtttacaataggtctgatgcgatggagaaaaagcagctaagcctacaagagtacgacactgagcaaccaactcacgatctgccacaggtgcacatttacgctgcagtgtcgtgcaaccacaccatagactcgatgttcaaccagagtataacttgcaactatcagtacattgttctgggcaatcagttgatgctgtttcacgtaatctacttcaagtacgggtgctctaggcagttgctcaaagactgcaccaattcgaatcgagtacagtaccgtctgaacatgaagggtgaagtggaacgcatctacgagagcctatcgtgtccggtgctgtgtagtgcagctcaactgcagccggcctcgtccaccgttgtgggagtgctgctggacagtatgctgatgcaaaacctaaagttgctcttttccaattgtacacacgcactgctcaacaagagtcccaaactctacttggagaatgcggtgcacgtaaacggtacgagtgcactgtttctcttcaacaacatgatcaaggtggagaaaaactttacggtcgcactcaaggcgttcatcaagaatatcaacaatttgattaaacagtttttgtttgtgaaaaagagtacaggcagtagtagtagcagtagcagtagcgctaatgctaaaaatgccaacaatagtgcagtcataaagtcggcagtgtatccgtgccatgttaccaattcgtgcaagtttaaacagatgcgtaccaagtttgaatcgtacgatcacaccagtgtacatgctgcactatgtacagccgacgccacactagttggtaaattttccaatttggaatatctgattctgttgaatgaaacccggacggtatttgaagaggtgcgaaatgtgttgcatgtattggattgagagaaagcgagtaccgtttaatgcaggttttgtgtaaggggttttgtgtaagaggttaatgtagcaggatgttttatgtaggcaggaggttttatggaatagaggttaagtctatttaggaggcatctatctgtatagcatctgatactaaaggaggattaatgtcaagaatctaatgtcgagaacctcaacttgctgtatgtataggtgtctgtatggatgtctgtatggatgtatggatttatgtatatatgtattttgcatgtaaataaaggagttttaaataaaagattgtaatataaagtcaagtagattttaatgtaatagtgtagtttaatacaattgggtgttataatctaacaagtaataatgtaattgtataaatcctagttttagttttttaaacactacatttgattatattttattaaacaacatttggatattaaaaaataagaatgaatattacaagaatataaaactataaaacataaaactatagaatataaacctatagaatataaaactacagaatataaaactaaagaatacaaaactatagctaccataacactaaacaaccattctcctcctcctcaatcatccatcccaacattgacatcatcatcgtactcgtcctctccgtcaccgtccaagtctccgtccccgtctccgtccatgtcgtcctccaaatcagaggcctccgattcggcttctagcttttccaaattaccatcaacatcactgtcgcactcttcagatttgacacttgcattgtcatccgaataatgcggctgttcattgtagtcggcatcttcaacctcagacttgatgtccttttcagttttaatctcagacttgggctcacactttggcacatccgactcgtcaatctcagagcccgaacctcctctgtccaactccgagtccaaatcactactgttgtcatcgtcgtcggtaaatctcaatatggactcgtactcggaatccgagtctagatccaccggtgcctcgttgctcttggatcgtttaggcttgtgttggtggtcatcttccagtttgcgtttaatgctaccggtactgttgcttctgaccacatcctttttagcatcctttgttgttttacactctttgcgtccatccttcaattgcttgcatttatccttaccaaacaatgcagcacccttgctcttggtctttttgcacttttcaatcaatgcaaaggctccctcctcgtctcggcctttagcttcaactttggtattaccactaccatcgacattactaccactattgctactactaccactgctactgctactatccacactaacactactcccatcgccaccaccaccgccgcctccctgtactgccttcaagtctgggctcagattcaagtgcacatggcccagtttgattagatccagtacaaaggcgttctcgttgatgctctcgttgagcggatactgcttggacatgagattcatcgtggcaatcaggccattggccacgaaaccattctcggccgtcatcagatcgttcttgggaaacatttgcttgcacttggcattggcctcgatctggtgcacgaaaaaggccaacggggcacaaatctcaccgtcaccgttcaccgccaagtctggactgttgagcatgctcagcgtctgcgacgacgtggtgcgtcccaccagagattgtttgctaaacaatatctgcggatgcaccatctttccggacgcggtccaaaactgatactgcgacagatccttcaccgaagacacgatgcccttttgtccgtgcagattggccaacttggtgccaacacccaaacgttccgtatagtggtagtggatggagatcatcgacttttgattggtattgttgatttgaaagaaagagtctatagtcttggatttgcgcagtggatcactcattgtaattagatatctaaaagtgttctttataaaagacttgtgtatatagaccgatctgcgtcgctgtatccgtacctggtggtctgtgatgagcactccaaacacaatgactccgtcaaactttttattgatcggtatatacttgtaggtgccgttgggcttcagagacatggccttgtgcgaaaaggtggacttgtcgtcggtgtgagcgtacaccctcagcagtagagtcaccgaaaacagtttgagtggcgagttgcgatgaaagttttcatctataatgatgccgtcctctacactgtcacagttgagattgcacagggccgtgtacaagagcatacggttcgtgttcgagtacgtgtccaggttcatttgcatgcactcttcgtaccgagactcgtctcgtttgctggtgctccccggcggtacgggtaacacattgtagtcttgcatcttgattgtgctcaactgacgctgaatgcactcaaagtgttcatcggcatcgtgcacaaacaagtctcggtagcactggccctcctcctcaaaggtcttggcacccaccatgcaaggatccaataaatcggccctgccatcggttatggccaagttttcacgcttcagcctattgtagtctttgaaaaactcgtgcaccgtctcgggagcctccatatagtactctttgcactcgggctgaatctcggccaaatgggtaaactttgtggccgccgccttgatggccagcataaacttggaggaatcgttaaagctgacgcactcaaactcttcgcccaattgacgttcgttttctcggtcgtcgtcacaatcggtcaacatgccaatattggtggtcatcacggcagagttggtgaatccgatcgagtggatgaatgcgtgtagatcggatcgactcgtcagcgtagagcatgaacccttgatgttgttgatggagacggtggcctttgccggtggcatgtgcaacagggctcgatgaaagttcatcgcaaacgtagtgtaggccgcaaacgatgtgtagccctcaaaggcgtctcggtaagtgttcatggcctcgtgcacgcccacaaacatgcgatacttgggcgaatactttaccggcaagtggcccacatggtacacgaccagatagcgatcctcgtacaccatggtcaccacgatcatggctcgcttcatttcgatgacatcgcacggccgaatgcgatagttggtgagccagccctcgatcactacgcgcaactctgcctctggactgtggtggtcgttcaaaaagtctacgatccgctccagtgaaacggccggtgcaatcattacaaactgcgctagagccatcgtctcgccggcattcttcatctccttgacgttgagcggacagataaagttggacgagtcccgtggcagtttgagtgcattcgagtttttcacaccgtgattaatgtgtcgctttaccgtactgatgagtttgtcgatcatcgacactcggtggccctccaccgacaggtaggccgtcttgaactcgtcattcttgatgtagctcaccgtctttgaggatagcgtgtaaaacagattgcccgacaccagagtgcccagcttggaagagttttgcggtagagtgctccatttcttgatggccgtctcaaagatggaggtcggtgtgattatagtcttgttgcacaaatcgtccagctctggatagttgttgatgctgcactcaaaaaaatcaatataatcctctggagtcacagtgtgtgcattgtcagtgattgcgttcactggactcagacgatttatgagtgcaaagatttcctcatcggtattgtcggccactatgcaatcgtccttgatggcatagcctcggactcctacgcgcttttccgtcattcgtttcgtgctcaccagcttgactcgagtgttgaccgccgcaatcgtagagttgcccttgcgtctgcgcctactgcccgattccacgacgggtgattcggccacattgggcggatactgaatcatgtgcacaatggtactgttggcatcgtcgggcacgtcctcgttgagataccacttgtactcgttgctcggtctgtacacgtggccgcatcgcagattgttggtgatgaaggccggtaaaatcttgatgcctccgttcaaaacaaaggctcccagctgatgcttaaagtccacattgggtctaatcatcatgtcaatcttggagccaatcattatcggcaagaccttgtgcttgacgatcacttgattgttgctacagtgcaattggatgcatgcagcataagatttgttgtactttaacaagagccgaatcacatcttcgccgtctacgcgcttagactcttcgtagacgtactcgttgtagcaaggacaattgtagattatcaatttgtccatttttaggttgtactcgtcaacaatggtttttgcgtaaaaatccatgtttgctgctgaacgctaaaaagcgtgttaccgcttcaaatgttcaaccgcttactaataaccgactgttgatattacgctatttatactattgagactatgggcgttgtcattgtttatagatttagcggaaatcatgttctgttcaactagctcgcagtcgggcgctcagcggtgcatttttcaaaatgtatacgtcagatgcactctaccggtggcgggaatcatttgcaacccccatctgaatctgttgttttcgatgagtctggtcaagaatcgggtcgtcatcaacaatgtggccaagaccaaagtgtacatggctccgactcccaatctgaggggtgacaacaaactgattccgttcccgtactcggtgtcggagggcagagtgtgccgatcgccatccatcgaaaatataatctcagagatgcaggcatgggtgagccggctcgatgtggatcaggcgtctgcttgtcatctgactcagattctgacggtaatgtttaccgagaacctgattgcatctcaagacatgagtcgcaactcggacaacatgtacctgaaccagtaccgcgactacatgcagtacattcacaagtatgacaaatcactcaattctagatttgccaacactcgcatctttgcctacagccgaaacggatccatagagatgagcatgacgctgatgcctcagattataaagattttgctcttcaactgtgaggcgtcaaccaactacattccggaggctacatcgtttccacccaatctgtacctggatttggatgcgagagccttcaagttgatcaatcacgatatcgtggccaatccgattgcctactatgacgtgaaccgagacactgatgtagcgtctccgctagtgtttgccggtgatgctcgcgacgacgtcaatgtgctcttttcacgcaacctggtcaactttagagtgtccgaggttggaatcgcattgtgttcgtcttaggtgtgcgtgtttgtgtttgtggttgtttgtatttgattgtatttatttgtagttagaataatagaatagaatatcaaatattattatagaatagatggcatttttcaatagtatagaaatgtaatagtgtagattatccaatagtgtagagtatccaagtaaaagtttaagcaactatcaagtgtacattttttaaccaattcaaactcttggtcaatcaaaactcgtagtcaatatttaaaacccttatacgcagtcaacatccaaaactcttatacgtagtcaacatccaaaactcttatacgtagtcaacatccaaaaccctctcattccacattcaatcaaaacctcacattcaatcaaaccctctcattccacattcaaactaaatgtaattgtagaataaaaaataattgccgcatgtaggaatgtaaacttgattgcagtatgtagcacaggaagtgtactgattgaaaaactttatagcttaaccgagtttaatttttttaatcttgatacatagatggatgagaaaagatgcaatatctactgcctgcactcttggcactcgtaatgtgtcttgtgttttactttcaacttggcacagttggctgtgatggtaacactagcaaaaacaacaacaacaccaacaccaacaacaacactaagaatagagcaactctcaagacgggactagaatatggcaagcgcaagagcaactgttcggtggacaaggtgtattgtttcaccgatgcacaatgcctcaactcgtgcatggaaaagatgaatcacttgtacgattgtataaacggcatctgtgaaatatccatcaatagactcaaggagactgccatagttcagggtgagccgtgcaacactgaaaagggcatgttcacctttataatgggcgatccagcaatgggttcgtacatgagatcgtgtaaatccgtcgacttgggtattgcaatttcaaacacggaaaacttgatgtgcaagggcgaccccagtgccgtcatcaactaccactcggcgtatcccatcatggacgactgtaccgactgcaagcaaccgatagtcataccggcaacgtacaacaagcgcagacataaagagtgcaacaatcccttttatcgcatggtggagcacgaaaccaaactgtacgaggaacaaggattggcataaatggagacattaccgtttgcataaatacttgacggatacgtaaaagtcccacatagtttagaaatttgcataaatgtgtaaatttacaatttaattgccatgctagaaatccaatctaaattttagactttgtatgattataggtgtacaacttcctgtaatgttggttagagatggttattttttcaactttgtaaaaaatgaaggggaccctctaggcttattttttaatttctctaggctattaaattgcggttaattcatagaaaccggttgaataaaatattgaaattaaccactttgtgcagtttttagtttttttttgattaaaaaacacgaaaatgtcagtttagtttattgaatttacttgaaatcctacttcttgattaaaaaaatcaaacaaacacaaatacttgtaaatcattacattattacaaagcacacacactaatcatttccaagatttaacgatcttggtcaacaatagatgaccattagtcacagtctttgagtcatttgacccaaacatcgttaaatagcacgtcttcgatcgtctttgtcttgaattcaaatgaatttttgcacttttcaaagattttcaaaaatgccatgaaattcatgtgcgccaaaatttcttggcgactaagaacacccaaagtggtggtgtcttgcactacaaatgcaatattcttcttgtttgtattcaaaaaagtcgtcaaccactggttggacacgtgtcgatatctgtagagtttaccctccagtcggattgcgttgatttttctacctccactgggctttgtactgagtaccgtccgttgattcgggccctttgtcttggaatagatgcgtatggcaataaagtctgggtaggcttctatcaatgccacctcatcgtatcgtttcagttccgaatgcggaaccagttcaccagtgttttgattgataaaactcatagtttgtaggtttttattaatgtttacactacacacactacaccgactgatgtgtgcgcatactagtgagtgtaagtttagcgtacatataggttggatctctgtgagcgtccgtcaaataaattaccgagcaagtgcagctaatcagccagtcttgttcaagttctctattgaaagagtgcggtcgcgatagtctttatagtgtaaactcgttgcatctgaaaactacaatacgttatatgtgcgaggtattataatgggttacacgccgatcaagtccaagaggaaggatggtcttagattttttgatgatattggcggtcgtggtactactcttgttgacggtgacatttataagatgcgtcaacctaatggttcgattgcacattttgatcctgatgagctcgaacgagagctatctcgagtaccagactgcaactgttactggtgcaaatgtcgccgctaccccaccgacgccgccgccgacgccaagggacgagatggagctgctcaaggagtggagtttatcgtaaacggttagtgttttaatgatgtttttccgaatgtcagtcatggctcaaaagtaggtcaaggtcaagaaattgggtcagtgaactgtatagtacatttagcaagtgtacacgtatggaatgtagggtttttttggttttatttagacatggcattcaattttatgcacttgtatagattgggatttattggcaatttcaaatggttttataggggtaaagactggtaacggaggatggcaaaggatggaatgtgtaggattgcgtgtaggaatttgcgtgtaaggttgtgtgtaggattgtgggtgtaggattgtgggtgtaggattgtaggtgtaggattgattttaggattgagtatatgattgcgtttagataatgttggatttgtacaattgtttttattaatgtaagagtttatatccttgtatatcctcattccttttatccaaaggtattgtgtgtttttatcaagtaaagtacaagcttgtacaaagtactaacaattgaattctctctctcacgcaggcaccaaacttgatggtaccggagtggtctgtccctgtacgatggatcaaaacgcttggattggtcaacatgctttgatggggcagcaaaagggtccaagtgatcaaccgactctgatggagcaacaacaccagcaacagcaatccatcaagaacccgactgagccgcctctaccgtcttcggccagctactactattactattattactactactatctgaaccagcactacaataatggcaccctgccattctgtggagatgatgtcaattttaaaaatttgacaacaactgcaacggctaccagtggtggtaatatcaacaccaatacaagtatcaacactaatagcagcaccagcatcaacactaatcctactacaaccaacaacccatactcttcttcttctaccaccaatctactgtgcaatgaaaagtttattgaagatgaagagattgatccggtagagttggacgacaccaccaaccaagtctacattccgattcatgtcaatccggccaatagtgtgactgtgactgcgctcaaacccaagagagtgcacaagggtaaacgcaccactaccaccaccggatccggtaagaagcgtcaattcaatctaatcatgctgaccacgctgtacattacgtctcgtttgttttccgtggcaatgggccaagaggtgttgcctgcatccgaagccactccggcctcctctgaagctacgcctcaatctgaagctacaccggcctctgaagctacaccggcctctgaagctacaccggctactcagcctacatcgacttcaccgtcgtctgaagctacaccggcatcgtccgagacaccgccatctgaagctacacaagcctcctctgcggctacaccggcctcttctgaagctacaccggcgtctccggcatcagaaacgtctacagaaaccaccggtgcaagcaccagtgccagtaccagtaccagtaccaatcccaacaccagtactggaacaacaactacaacaccaagaggcacaactgttacaacttcaagaggcacaacaaacccagcgactacatccgctaaccccataactgcatcggccattccaaatccaatcaccatgtccccgatgccgactagcacggaatctcaaatgacaacattcatcattgtgttgcctcaccatactacaactacacccagctataataccgaggccactgctaccgtggtgattgtatcttgtgatatcagagatttcccttggttgactcgtaaactggccatagacatgtttatgaacggctacacggaccagccaaggagtagccgcatcgattcgatcgttagctttataatggatccgtttctttcaccgactccacgcaggagtgtcgtaaacaagattccctgtatgcaactcgtaaaggatgtcataaatatgaaatatggtcctcgcgaaggctaacattaacaacactggcaacatcttcttctcctccttttatgcagacatggctatgaattttggaccaagaatagatttagatttcatgtttttagaatgtatgtagatgcaatgtatgtagatgcatgcagatgcatacattttttttaacattttataaacttgatattttacattttttacacattttataacatggtggtgggatcggtagctttaggttttggtggtggcttttgattgtttattcatcagggatttttatagatttttcttagatttagttgctctaggactcggtctaggactcggtctctagagtttttataaacatttaatcattgtggtggtggcctaggaataaatgcataatcagtggcgtggtggtactggattacaacattattattacatttatttttagttgtctggtttaaacatttgcaatattattttataacatttgcaatattattttataatacagttgaaatcatataggttagaggtgtaaggttatattatataaaattgaaaaatcttggtatagggatttggtacttttccaatagtaataattgaacatgcatgtgtgttttacataatatttaaaagcaatacagatttaattgaaccatagggtgtaagattgtaatatgaaacattcatacagatgtgtcttgcttggatttgtagatggtttttacacgagaccgtttatccaacatgcatacacaataatcatacacatttgtacaagtatgtgatttttctgtttaacgataatttaggctgtagaatcatcgtaagaagtaaaacttgacacgaacaattgtacacacacaagacgattgttttttaatataaatactagagcaaagaggttttctcaagtacagtctagctactactactatctctaaattgtattctaaaaaatagaatctttggcagttttaaactctttggcacctttagcatctttattagactcttggcttgtgtttctcaatttaggtttaattgccggtttatttacacatttagttttattcaaacatttagagtttatttaaacattcaagttttaattgaacgttaagttttaattgtgtgttcaggtttaattgcacattaaagctctaacgtcgattttaggtttaaacggcatcaacagcaacagctctctgtgtaatgttttttattcagcatagtggtatcaatatttataatttataatttataatttgtaatttgtacaatacttttatatataatttgtacaatatttttatatatacatatcagtatttaaatgatgtaatttttgagccccagaatgtgtttcttttttgataggtgatgatgggatacagtaggtgtataagaaataccattacatgttttttataagaatagttgagagtatagaatagttgagaatataataatcctagcgtaatttacaattagtggtagtgtgagaatctacatttcaatttccaacctgcaaactctcgccatcttgcatctcctctgtccaacatcagacactctattttgcacattatcgtacaggtacacgggacaacgcaattgattcaagtggagaagatggtagagtttagactagtatagttagaattgagtgtacaataggatgaaatacgtagtaggaataggtagggttagtttagtgcttaggaacttgagcttgaattgaaccaggatacactagcacggtcattgaaactaatattgctgctgctgcaactgtagcgagtgtaatgtgtagttggttgtaggatatattataaggtttaattgtaaggtttaattgtaaggtttagttgtaaggtttagatgcaaggtttagatgtaaggtgtgtgcatgtatatcggtagagtatatttggtcgcatagatttagattttatatattcaaatcaatgttcaacttgctttcaatcaacttgctttcaatcaacattcaacgcatcattcacgccaatagtcattttagcagtaaacctcaaacccatcaaaatcatcagacccatcaaagtcaccaggcatcaaatcaaaattcctccatgaaagatggcagttttatatcccaccgagggtgtgctaatgttgaattttacgacatcgtaagagtttaaagtaacaacactttaatgtaatatgccagtaatatgccacaagttgtaatgtgatacaagtagcagtactggtagtttacttattgatggttataagatgattatttatgttgtatcataatgggctaaagttaattagttttcaccaagacctgtaagcttgaaccgtaataaatgcaaaccttacaagccatataaaatttacatttaacaatttatttagttgaaatttacatttacatacaatttatttagtgctataactattttggcatacattacgagctgtgattatctgtagactgcacgcatcctttaatgtgtattattttgtagtgcttagcaataactggtagatttctcgtaaaattgtacaataaaaagcattccagattgctgtctagattagctttttaattgtacactttaccactttgatgcatacatttggtttaatattctcttcaatttgcaatttaattaatgttcaatttagtatgtaattgtgtattgtaaagtgttgattaatacaagttcaagtgcaaaggttcaagtgtataaagcgaaagaaggtgcatttcatataccaacaggaacactgttatacctatagactttttcaaaagcaagtggtttcagtgcgagtgtgtacatgtggacatttaccatggagtgtgttggaatcattgatcctagtatatgcatttggcagtagttttttcgtcgtgacatcccccctatagtgttgtaagagtgtgatttagaattactaaatgtatagatggataatataccacatagttgtatgttagcgtatgttagcatggataggcatggatagttttagtttccgaattgtatttcctcttagtttttaatgttgacatagatttccaatttagcaagttccaattaagtaagtttaaattaagtaatttccaattaagtaatttgtaaagtagagcaacaacacggtaggttaatgttgatttttttcaatagtattggcagtgggtaggtttaacgggtggggtgtgtctttgtcgtatgggtcgagggttatctatgtttatacaagtttatataagtttaaaggtttagttttggttcactttaaggtacagcgtgtttattttaaggtatagtgtgtttattaaatgtttagtttgtttaaggtttcgttcattttaagatttagattgtgtaagttttacaggtaaaataagtggaatagtgtaagcaccagcataagaagtagtgtcgatttatatagtgcttccatttagtatgcaacttgtaatttgtagcttttgtacaatttgtaaattttgtacaatttgtaaaatgtagcatagtttttgaatctgcgtattaggtcaaccttggattgctatttatttatattgtaaggcgtattagttaattgtatagaatcgtgtatttagcatagtagtattagtagcattagtagcattagtagcattagtagcattagtagtattggtaagtagttccccaatctatcccaacggtatttattcggcagtagttgcattggcatctagtagcattagttgtactagcagtagttgcattggtaggagttgtactagtagttgtacgagtactagtagttagtagtaggtaattcccacgcatccgagtattgagagagcccagaatacatctatacttatcagcaataagagaataaattgcaacaatcagatgcaccaataatctgaaccatcagaaataataatcaagcataacaagtactagtttaagccttgtaaaaagtgtagctaagcagtaaacacttgactgtgataataaatgttggtataagcattctaaagttagtgtttaggtttaaggaggcttagaggtagggaggtagggaggtaggtagtaggtagacggtagagagacgggtgtttagtttaagtttgggttatgttaaaatttacactttatagatttgcacatagtatagttggatttgaacatagtatagtttgatttacacatagtatgatttacacatagtatagtttctaaaaaatacaaaatccaataaaaagcataaaatgtaagaaacccaaaaacaatacaaaatccttgaaaatgcacataaaaattgtaaaagcataaaacacaaaaacattcaaatgagaggtcaattgcacatgtagagttaagcgcatcgttttgttttaatttaagcatagcatatagtggcacacacttttgttgtaaaatgtaaaggcggtaatacaacaacacaataaattgatgtaatgcatcataaactagcaagtaaaataggtagataaaacagcatgtaaatagcgtgtaaggtagctcaagtaccatgtaagtagcccataacttagcaaataaattagcaagtaggagttttgtcgtttcttttatcacccatcccagaatttcaataatgcaaaataatggcactcgtatactataaaagccatctgtatcatgttatagcagcagcaaggacagtagtaaactgcaaaagtcgtctcagtcgagtttgtataaatgcgaatgtaacacgcgtttgttcaacaatattcagttgtctgataaatgaaatatcgtattagacttgtacaatttacgtgttttatagtatttgtgcaacatggatccgatcataaagagcaccctggactcttatattgaaacatgcgattacatatcgctggatacggtcgtcttgttgatgaccaacaaagactttaccctggatcggctgattagtgtctttgaggccaacgaagcgggaccgtctacgcacgatttcatacatcacgaagtgacaccgttcgaggtgagagcctacctcaggcgcaaacagtgcgtaaacgttagacgtggtctaatcacagacgacctgaaacggtggttcgatacggttcagagaatcagtggcagtataacgaatcgtaaagcgtttgaactggccgtgctgtttaaactgtttcccaagtactcgatggactacaacataccgcacatgctcagcgacctggcatcgtatacgagccttaaagagtttttagaatttatgcacgaagtggactcttgccgattgaccacgatcaatagtaagctactgcaaatctttgaaatgcaatacatcgatcaggtgattgctcacttgatgggcgacgaagactgcaactattacgtgaacctgaacgaggtgcgtgcctacaaggactcgttggtggcctttttgaagctcaccaaagccaaacgcaaaccgacacatgtgcgtgaaatggttagattgtcacacagcatggacaggagcatcgtaaacactgtactcttggtactgttcaagagcatcgaaaagccaggcttgaagaccaactttttcctaaagtgcatcttgttgtaggaatatggttgtaagaatatagttgtaaatctatacttgtattaataaatctataggtagttggggtatgtaaagtaagagtgtaaacctattcattgtttaccacacggtcattaactaatcatttccttgtatttaaatgtctatatgtatacttgtacttgttaatctagttttttgaataaatagtaaagataaatagtaaagatagatagtaatatatctgtgtagaataaatagcaactgtctgagcaaacatggacctcgaatatctactgaccaaactcaactgcatcaccaaagtggaagattccgactatggactagtggaccgattcaagctggcacaattgggctacctgttgttgattgcacgtcaagacggcggcaagtgtaatcatgtcgattttgaaagtcgcatgtttatccacgacacactgcacgtggtgcaactcggtgagatttgccaagaatgcatgagtctagcgatgcacgacaaattggtccgagtcaaactatcgaaaatgtacaagtcatcgtcggtgcccaacatgaagagtatcgagcgtcctccggtgataccgtttggcagtggctacagacgcagcaatgtctggaagaatagggtttagttttatactaatgtaaaaagtgttttatactaatgtaaaaagtgtacatttttccaactacactacaatactgttcttgtatcgagtaaatgcaacattttaaacaacacgtgtacgagtagttattttttagtattagcactagtagtagtagtgaatgcacaatttccaacaacttgatcttactacaaagtctagcatacaatgtttgaaggttactggttaccattgtgcaacctaaatgataacggtacggtgtttaatgaaagcaacaatgaagagtccgataatgaagcgtacaacaataacgttgatcaaggcattgaacgtgatgccagcacaccaccgttcgtgttgtctacacataaatttcacgaatgctacacgttcaaaccgagcgctcagtacgtgtacgatgtgtgcgatgccatagcggcagagtgttccgtcgagagcaccatcgatgcattcgaaacggacagaggtgacgacgaatggttctgtatagatttcctcaatgaacgcacaacaaacgatcccgtagatcctgcactattgcctcccgactctgacctgaatgcaatcggatggtttgtggtagactatcaaaacagacgaatccatacaaacgatcccatcttttatccggtactcgagcatgtctacttggaattttacgctctaaaatacattatatttgtggtactaaaaaatataccacgctttgtagttcacattgtagattaccatgccgacattaaacctgaagtgtcgctatccaataatggcattggttactgcaattctaaaacaacgacaacgacaacatcaacagcaacagcaacaccaacaacaccaacagcaacagcaacaccaacaacaccaacagcaaccaagattgctaccatagagactagaggtatctctgacatgtttctagtttggatttggaagggatcgtgtgatgaagcttaaagatttgttgtaagccaatttggaaaccaatttgtaaatcaatttaaaactattgtaaaaataaaagcattgtttacatgttcttaatacatttattaaattttatatacattagtatattttatatatattagtatattacattacatttgtttattaaataattaattaattaaagttgtacaattgtatcaagttgtatttttttattaatctacatattctacatctacatcatcatcaacatccacactgtcagtgtcctccaacaaaggccgagtatcaccaccgccaacacttccaacaccactaccaacaccactaccactacctcctcgtccccgtcctttgagcaaatctcccagattgaatttgacgtacacgaatcgaccaatgatgactagcactaccgcaaccactgccagtagaatgtatttcaggtacgagcccagtttggtcatgaacgtagagcccagaatgtagtgggccgcatcgcctgccgcatcaacgatcgtctctagcagtgtagaattggtgacacacttgaaagtcatattatcgggcagagtgtacgtattgacgtaggcgtacgatttctcatcggcattgggatcgaagccggtgcacggaacctttgccttgtccgcagtctgcaccagatcgcagggattcttcaaaggatgaccctctgacgaatggtagtagtgttccgacactttggcaaacagagtgtcgttctgtacgatggtctcgaacgtttccatggtgggtgtcacaccgcccagtacattggtcaaactctgccgttccatctctgcactgggatcgttgatggtgtgcaaaaggtacaagactggattgtccaaatgatcgtacttgactgcggaaatgtgcttcactcccgtcacggaggtgctgagacaagatctagtgggcaccttgaacgatgtagtcttgcctcccttgagcaccaccaagtagaagccgttgcgtgcaaccgtagcctctaccagcttttcatagtagggtactccgatggatatggccgcaaatataccgaccgccacaccacccactttgaccgtactccacagattgtcaacgatgccctttagcttggtcctggaggctttcggcaatcgttccaagtctgaggcgctagtcaccacaatgtccaagtcgggatgtatgattcgagcactctttaccgtctcttccatgttgcgtattctaatgtctggggtgtcgatgagcttgcgaaactttagctcatcggccaccgttatggcggtgggcttgttcagcttgctaaacatggacgccagctctcctcggcgcaatagcgattccacagtgtgtagctttacaccgttcacggccagttgccgatcgaccaggctatagttgagtgtgccaaacacatcgtcaaccgaacgtataccggtcttggcatttcggagcgtgctcacggtactggccggtatctcgtctactggctttagagcgcgtctaaagatggatgtaaaactcattgtggtagagcgttgtagagtttggattagttgatagtttgcactttataggttgtactttatatgttgtactttataggttgtactttatagttgatactttagtttggattagggcaaggtactgggggataagtaaaggatccgtattgggtctctaaaaaataagaataccagtggggtttagtttttatatttatttttatttaatattcaatattattaaacattagttttatttagtattctatattatttaacaatatttttatttagtatttagtatttaatattatagttgtattattatagagctgcaaaggtacaagtagcctacaaagatacaagtaaactacaaagatacaattaacctacaagttacactagacaaaatacaccaagactcactccaacctagacctctttgctgcactaccttcatcgtcctctgtagcatctacatcaagttgcatagcttcatacaaaccaccttcatctaaaccaccttcatccaagcaaccgtcatccaagcacaagtccttttctataccctcttcctcagtttcatcaacctcgtccatttctgtaggttcaggattctcttgattttcatcaatatctggattctctaaattctcttgattttcatcaatatctgggttttcttgattctctacaaaattacaatcctcctcctccatacactcttctttaacatcatactcaacctcctctttaacttcatccttaactttagcctcaacacactcctcataatttaccttcacctctacaccctcaacctcttcatcctcatctatcgactttacattacaatccgaaaaggacacgtccgaatcgttggcctccactttggcattcttaaagtcttcaaacacctcaccctcatccattagattgttcatcaactctttcatagccttttcattgtccatattgagttttgtaagcgggccactacatctgccgataaactctttggtctctgtatagtggcaaaagtcattggacatgggacacttggcattgtacacgtccaccacaaactcggtactagtgccaccaaacacatcgcacaactctttaaacattctccgttcacgattggtggtgattgggaaaatgttgctagtgctgctcttgccgcccatgttgctattgctggccggtatggagccgcgctgtggtatcgcacgtttgggcttgatcatgttggccagcactcgttgtggaaactctccgctcacagcgtgcaacggcaacttgatggtagagttggtgggattgttgagattgcgattcagtagaaacatgacggccacaaagttgtacattagtatgtactctggtttactgtgatccacgcacagtgaattggtatagtagcaatacaaaaagttggtcagattgtcagtcatctctactgccgagatttgcttcttttgatacagctccagcatgactctacagttggccacaaacactatgcgcgtaacatgagggcatccgttcaactgttccagctgcgatagcacaatctttggtccgcccaccttaaagtaaaactctacgatattcttgtacagaatggcatagcctacgcaatccttgactgcggccaacactgcatccacattggccacactgtccaacgacactcggtaccagttgaacgtctttggtgcgtacagccacttgatgcaaatggacggagtcaccggattcatagtgcccttgttgaacatttgcgactctttgacatccttgagccgcttcacgttcagtgcagtttgaatcttttgcgattgaatcatgatactatagtgtaggccaatgggtgtcttgtcgataccctccatcatgggattctttgaagtgtacaacagatacaattggttcttggtcaaattctttagattgatccagtcctcgtaaaactgatcgtagagtgcaatctcagccttgatcatttccttttccaactctaccgggtctagcttcttgtagagactgctgtgtacactgctactgcaagtggtactgtctgcggcaaactcatcgtccagcttgcgtttgaccgcctcctttttgatgttgtactcggcggccctctttagtcgcaaacggttcgcttcacgctcaatgcaaaccttgcgcgtaatcagcttccacacggtgacgaatcgtgcaatgtttagattgtctccagcctcggaatcgactcgattcggtggtcccgtaatgtcagtcaccagtgtcgattcagacttgcccatgctattgatgcacttgagggtgcgtctaaaggtggccatctgacgcttcttggtaaacagactgctatcgtcaccgtcaaaggtaaagtcatactcggaccgatcatagttgcaccacttggagacaaactcttccgaattgatcagtatcagtctgagaatgaatcgcaccgaatctggattgtacttgtacacgtccatcagagaggtttcggtaaagtttttcactgcaatcttgtcacccatatagagatcgcccatcatcagtgtggccggcgacagagcgtgcaacagcgaaaactgagtctggccctcgcgttccaacactttgctggaatcaatcttgtcgtcaaaggccgacttgagagcctgctcgtcagacgtcctcgtcagattgtacttgtacagttcaatgtgccgggcggtaccctttgacttggagtgcaccacttcgagaatctcatcgtcacactttagatagtccgaacccctcaggcaattgtcgacattcttacagttgaatgccaacaccatttctatgaaatcgtgcacctcattcctcatgatgctacagcccaagtgcatcagagtgtcaatctttgccagcagattgccacggtgcaccttggtgaggattcggtaaaacttggagtgctgattgaaccacttgtcgtgcgtgtagagcaagtgcctaaactgttgacccagcgcatagcgtggcttgtaaaacagattgtgccgatagccatagttccaggacatgctgcgcatctcggtgatggccatcttcattaggttgcgattcatagagttttcatacttgaggtaattgattgagatgtcgtctccgtcctgatcagcgtgcaggccgtccaatacaaacggattcaagtgaatacagggatcggtgtcgtgatgaaacatttcacacacatagatgcacgtatcgttgatgctcgggtcacgattgataatcaccaaattggtggccagatccaggttgtcgtaaatgtctcgcggaatcgaaattgaattgggtcccagctcattgtccaccaccatcgtcatacgggctccgttgtgtctgtggcccagcaggtaggatcgtacataggaccgtttgcccgattgtagaatactaaagttgctgcacttgaaatcgttttgcagaaactttttcagagtcctatcaatgtacttgtgaatcaaagtcttgacatcgtcgcacgaaaactcattctcctcggacggcttgacgagcttgatcttgtccggcatgggagtgtccgtctcgtaggcgtgctccatttgaaaactcaactcgatgatggatcggaaaaagctaaagtttttgatcgagtacatcttgggcaggggaaagatgaagcacttgcccagtactcgtacaccaaacgcattgctgtactcgtgcgatgccacacagcactcggcgtccgccttgtctggatcctcgtcctccagaggttcggtcaacgagtctagtgcatccttggtcagagtcactccgtgttcgatgcacattttgcagtcttgcaatccaactggtcgcaccttcttttgatcggtacgcttcagcttgaacaatcgatacagatccttgacgtctacaatcagcgtattgcactcgtccacgggctctatagagtagatttgcgcagtactccagatgggtttagagttggtggatacaatctccattttagagagagatgttttttagattagagaggtttatttataaatgcaggataggtacagctgcagtcagagagaaccgtctactttgagaacacaataaagactgtaccggtgacaaatggtgttggccaatttatacacacttgtgcgcatttaataaaacattgcataaactctgcactaggccacgtgcacatttgcacaatgcccgataggcactctgacagtgatcgacatgatttacttggattttaaagatttacaaaaactacaattgcccgacaatgcgtggaccgaagagttgatcgatcagcgcccctgtttcgtactgcgcaatccagtctattgtcgagtgttttggatgcacctgtggcggactcgactcgtggactcgttccggaaacagcaaaactttgatcgaatcgaaaacgtggacctggatcggatggtggtcatcgatgccgagactggggctctactctcggcaccggcatcggtcaacagtctagagacgtttgaacggctcctcaaaaaggacacgtactatgcgtccaatgtactcttgaccggtgtgagcactacactcatcacggtggtctatgtgattgtggtgattgtggtggttgcgatcgcttgctacactagcctatcaaagaaaccaccaaagagtcgttggtacgatatgctactcttgttgtagtataaactagcttaaactatgtacttgactttgaatacaacaacaataggctattgtctctattccatcacacacaatagtagatttgggagaaaccgctaatactaatcatggacggtcagacttcgtgcatttccgagtttaacctcgaagagcccagcagtagatttaccctgtttcccatcaggtatcatgacatttgggaaatgtacaaaaaggctcaggcctccttttggacggtcgaagaggtcgatctgtccaaggacctgtacgattgggagactcgtttgactgaaactgagcgagagtttatatcgcacattttggccttctttgccggctccgatggaatcgtcaacgacaatctgttgacacgattctctcaagagttgaccattccagaggtgtcgtgcttttacggattccaaatcatgattgagaacgtgcactcggaaatgtactctacactgattgacatgtacattcgcgatccgcaacgtaaacacatgctctttaacgcaatcgacacggtgccgtctatacgtaaaaaggctcaatgggtgattcggtggatcgatgacgacaagtcttcgtacgccgacagactggtggcattcgccgccgtagagggcatcttcttttcgggtagttttgcggccatcttttggctcaagaagcgcggactcatgcccggactgacgcacagtaacgagtttatatctcgagacgagggcctacactgtgactttgccattctactgtttcgcaactatctgcgtcccgagtgcagatccagcgatgaaaaggtcatcaacattgtaaccgatgccgtgaggatagaacaagagtttctaaccgaatccctaccggtcagcatgattggcatgaactgcaagctaatgtgcgagtacatagagtttgtggcagatcgtctactgtacgagttgattggccgcaagatttacaacgccaagaatccctttgatttcatgaccagcatatcactagagggtaagaccaactttttcgagaagaaggtcagcgagtacaaacgctacggtgtcggtgtcaatttggaggataatgtgtttaagattagtgaggatttttagagagatgtgttgacggtggtgttgatggtggtggtagtgttagcggtgttggtagtgttagtattgatggtggtggttgtggtatagaaagatgtactagttttaaatgtagaatatatgtatagagtctacttgactgtatggatttggttgtatagaattgtataaaattatatagaattgtaatttagtatagtttagagtttagttttttagtacgagttttagcacaagtttcaatacaagttttagtacaagttttagcatagtatactctgtattttttgatacaataaatattcatatgtttaaaaaataaaacttttgttttttaatcaaacatttatttatacatacatatattttttatactcctacatttaaaagtatagcaacttgcaagtaatatcaaaactcctaaagttaacattatagcaacgcacaacattattcaaacatgtacaagtaatatcaaaactcctacagttaacattatagcaacacacaacattatccaaactatacaagtaatatcaaaaactcctacattcaacattatagcaaatcacacatctaacacaagtcaacgttagagtcaaggctcctactaaaggattcgacatcgtttcggatgctttcaatttgactcttaaactctgcactacaatctatcgtcttgttgaacgagtccaaatcgagcactcctcccgacactcgtacaatctctcgagccaatttcagagcacgatcaatgtagtctacgatgcgttcaatgtcacactctttgacaccacgggtcgtcaccgcaggagtaccgagtctgatgccgcttggtctgagagcgctcttgtctccgggtactgtgtttttgttgcaagcgattctgcacagttcgaggatgcgctctgccggtgctcctgcgagtcccacactgcgcaaatccactagaatcagatgcacatcggtaccgccagtggtgacggtgtagcctcgtgaaacgagtccctctgccaacaactgtgcatttcgcaccactcgtctttggtagagtgcaaactctagagtggtggcctggtgcattgcggtggcgatcgctgcaatcgtgtgattgtgcggtccaccttgcaggccaggaaacacggctcgttcaatttcctgctctagtgatttgcggtaaaagatgactccggctcgaggacctctgagagtcttgtgcgttgtagtggtcacaatgtcacaatactcaaaggggccaggaatgactttgcccgcaatcaagcccgcaatgtgtgcaatatcggccatcagcaaggagccggctgcatcggcaatctctcggaatcgtctatagtccaagcgccgaggatagcaactggtgccggctatgattagcctaggtttgaatagattggcactctcggcaagtttggcatagtcgacgagtccagtctgaggatccaccttgtacggcatgctttcgaaaaagagtgatgtagcggacacgttgcggaatccgtgcgtcaggtggcctccgtcgggcagatcgagtcccatgattctaccgtgcggtttaacgattccagtgtacacggcaaagttggccatcgagcccgagtacggttgtacacacactccccattcggactcgttcaaattgaacgctctgagacatcgctgctgtgctagcagttcgatgcgatcgataaactcgttaccaccatagtatcgctttccgggcctaccctccgagtacttgttgatgagacacgaactcatgcattctcgcaccggtagagtggtaaagttttccgatgcgatcaactctaagcctgcccgttgccgatcggcctcttgctctacgagcgcatacagctcgggatcggtttcgtagagattcattactggtattgtttggagtaacgagtctacttgacgagcccctttaacgagtccctttaacgagtctatttgacgagtctaaaaaactagaacatgaaagacaaactctgagagcaacttgacgagtctatttaacgagtctaaaaaactagaactcgaaagacaaactcgggcaataacgattccctttaaagagtctaaaaactagaacatgaaagacaaactcggacaacaacgattccatttgacgagtctaaaaaactaaaactaccaagtcaaagatgcactctaacgagtccatttaacgagtctaaaaaactagaatcataaagtcaaactctagcatcaaagagtcctccaagtaacgagtctaaaaaactagaatcacaaagtcaaactcggacattaacgattcactctaacgagtctaaaaaactcaaactctaaagacaaacaccatcatcaaagagtcacactaccgagtccaaataacgagtccaaatacagactccaaacaacgagtctaaaaaactagaattatcaagtcaaacaccatcatcaaagagtcacactaccgagtccaaataccgagtccaaataccgagtccaaataccgagtctaaaaaactcaaactccaaagacaaactctgtcactaacgattccaaacaacgagtctaaaaaactcaaactcaatagccaaactctacctccacctctaagagccgattccaaacaacgagtctaaaaaactcaaactccaaagccaaactccacctctatcatcaaagagctaaaatgcacaatttcaaacaaaacttgcacaaaagagtcccgagtccatgcataaccttgagagactcggtctaaaaaactagaacgatttccatagaaaacgccttttcaaccttttcaaagctgaaacattttgctcgtttctaagagagtcgacaccgatataacaccaatagcgtattagtgttaatattgagcggatttgttcacttttcgcattctgactttagttgtgcgcaagtttgcacgccatagtgtaaatacggtattgtggtaaactagacgtcgactttagcagtcttgcaataaatcatggccggtgttcgttcactttttaccgtgccctccaactgcactacggaccttgctcgcagtggtgtgagcaaatccttcaacatcctcatcgagggtaatattgcttgtggcaaatcggccctcttgaatcactttaaaaacttggactctttcaccgccatagaggagccgttgcatcaatggacaaactttaaagggtataacctgttgcacggcatgggactcgatccagtcaaatggtttgcggcctttcaaacgtatatatgcactacaatgtttgaggctcacactcgaccggtgcggactcctttcaagattatggagcgctccttgctcagtgttcaaaattgctttatagatgcctttgcatcatcgatcatggccaagagtgatcccaccgatgcagactcgatggcactcttgaatgcggatgtgctcaagagtctgtgtgaagtgttgatagacagtgtgcggatcgatctcattgtgtacatgcgcaccgatccctcggttgcaatggagcgcacgattcgccgaggtcgcatggaagagtcccacatagagttgccctacttggagaagttgcacgagttgcacgaagactggctcattcatggcaagaaaccgatcccggcaccagtgttggtggtggatgcaaactcggaatccatcaagggtacgattcgcatcattgaaggctttgtcaagagctatagctcgcaagagtacgccaaggacactgcccaagagtatgccaggtttgctagggacgctagagatgtgtatgccaagatttgtagagaggatagggaatctgtgtgatttaaaagtgtgctctaaaaattgcaatctatacatttaaccgtgtgctttatcccaacatgtattacaagtcttaataaagaatatttacaccaataatcgtctattttttttgattatgtaggcgagcgtcctttgttagtctcttttcctctctctcttgcgtgtctttactcatttgcatctttagctctatacatttacaagtatgaagggtgccaacattttagcactggcactcttttggtatggtgcgggtgcatttgataaatacaatacactacccgatcgtagaaactatgattttagctacctctctgactttagagttaatcctaaacatgcaccaaccatgcgtctagagaatgaacgctatgacaatctatacgatgacaactcgttcaatacaagagttaacggcaacaagcgcgttcatgctacagttagaccggttcgtaaacatttgcctacattacccagacttgttcctacctccaatccaacctatgccgatcatgaatctgatcttgctgaaattcacgcatacaatagacagaatccattcaatgcggtagatcaagatcagtttcagattcccgatgagtacattgacgaatacccacaacaacaacaggctcggcaaatgaatccgttcgatagggttgatgaaatacccgagtcgaatgaagattccgagatggatgccatgtctagattcaatccaatgaacccgttcaatgtggccgattccgacaatgaacaacctgagagtattcgcaaacgatacaacaccaaagacgagtccaaattcattacgcccgaggaattggagaaactcaaattcttgggctatctgcaagactttatggtaggcgcgcatcttaggttgactgatggtaaactgtcactagaggagcctgccatgcaaccggtagtcggtgcactagaacgattccaatcgtacgcaaacataccaatcaccggtgacatggatccgcacaccaagacaaagatgaacaccaaacggtgtgcgatgccagacatttcacccaagcgcgcaaaacgatacacactccacgacacatggaagaatccgataacttggagtgttttggccaactcttcgaatattgaaaatataaacgttatccgtaccgatgttgacagaatgctcaaacggtggaagcgagaggctcccgccttggagtttgtagaggtcgcccccggttccaattctaccattacactgggcttttatcatggcgatcacggagacggtacacgattcgatggcaacggatggttcttggcacacgccttctatccgggacccggcagaggtggtcagattcacattgacgccgaagagccatgggtcttttcgaataacgctgaggagcgcaaacccgaggattcggccgacttccaatcgatagcgttgcacgaactcggtcatgcattgggtgtgggtcacagtgatgttcacgatgccgtaatgtatccatactatggtggtgtcaagcgtgaactcaaagaggatgacattgcggcaatcaaagccttgtacggcaacagaaatggtactcacaccaatcccagtgacaaacgagaaaaggaatcgtacaaagaggctgctgcagcaccggtaacggaaccgacaccagtgacaaggccaccaccgacaccagtaacaacacaaccaccaccgccaccacagcgacccaagacggaaacgtacaaatccaaacttggcaatccctacatttgtgatttgcccaagtatgacagtgtggccaacatgtttggtgaagtgtacgtgttcaagggaccgtttgtttggcgtatgggctcgtttaatcccaagactatatcagtctatccaatcaacaaagtgtaccatttgccagactttgaaaagctagacgccatctacattcgcaaagatggtaaagtggccatgttcatcaatgatctaatgtacgtcttttcgggtaatgatgttgcacaagggtatccaaagaagctttccgacatgggcatcgaaggctcaaagattgacactgcctttagatggcacaacaagacgttcatactgagcggtgacaaatactggttgtttgatgaaaagaaggacaggattgcaacaaagacctacctcattgccaactatttccgcaacctacagacaccggtcgatgccgccatgtcctggctgaacggtaaagtgtacttcttcaaagacaggggcttctacgagtttgatgaatacaaaatgtcggtaaagaatgccgacccgtacgactctagcgtgttctgggccaactgtcctagagaccatccgcacatttgccagatgcaacacatgtacggacacttgacggcctcagactacaacacttcaatgaacgcagcaatggccgatggagcgtttgactactcgttgctgcgcatgattgacactgtcgacacgtttagatacactgtgattccagacaatgcaactcagccggaacgagcgtcgtacaagagactcgccaacggtcaagtggtggtggatgttgtaccagcgggtgagtgaggatgatgagattaaagtagaccaagattataagattataagaatagaataagattttaatgtagactgaatgtaatgtaaaatactcttaattaaaatgttttacaaaatactctaatgctcagtttgtataccaaagttgaataatgttgtagattataagatgctgttatagacttttgtattgtgtaccttgtagagtaccttgtaccttgtacttttgtagagtaccttgtagtgtaccgtgttttgtaaaagtttattaaataaagttttgttttttagtcaattaatgattctagttttttagacactatacctttaaatgcaaagagaatgcatccattcaactctacacatttctacatacacacacatgtctttaaagacaatacttttaaaatgtacacacacatgcatacagagagatggttataagtacctgcctctagcatcctccaactactctaaacgcctgctactagtctttagcaacaaatgtcaatttccatacaatgcatgtgcaaaacacaaaggttaaaacaaaggcccaatgtttaggaatgcacattgtcaaaggtaaagacactacacttgagactgtttgaaatgcacggttgactgaatggtgctcgggttgactgaatggtgctcgggttgactgaatggtactcgtgtgtcgagacttgatacctctgaggaccatcttacaaggggttactagttttagttttttaaacaacatgtaaatgatttgatgaaaaaaattaactcatttacaactctgtgttttggttctctttagcataccagaacttgtgaatcacttgtgaatcggacaactcagtgttttggttcttgtagctttagcataccaagtggacttgaaccatctctctacctaaaatattacaagtaaacttgaaccatctctctaccctaaaatattacaagtaaacttgaaccatctctctacccaaccaaacctacttgaatagtacaagtctataaaaaatcaaacaatttaaataccaaaaaaagaaacctttatttattcaacaatgatacatggtcaacttaatactacaactttatcctacaacttatacaattttattctacaatttagacactggtttacaatactcttaattctaaacaccatcactctacaccaccaactctgaaccctcaacactccttctcagcttttgcatcaatagcttcagacacctccttgaacagagtgttgaacggtcccaccttgactaggcgtactgcgtccatcagacggtcaagaaaggggcgcttcttttgtgcttcaaagttggcctgcaagttgtcaaacactgcattgagcagcttgctctcatccacctccttgacgtgatcgtactcggcagagctcatgaggtacgttagaatgttgcaaatcttttggttgacaaacaagtggttggatgatgaaaactggccatctgtacgctctgcgacagcctcctttgttggatacattttctcgtgcagagcatcaatgtaggtaacgtcaccgggatacttggtatcgttgcttgaaaacactgcatacaatttggtcagcatgtcttcatagctcaccggatcgtcacactctgtgaatatagattcgtgcaagttggccacaaactcttcggccagattctcatcggtcaccgcctccattacagtgtcgatggctttgatccacttttgatgtgactctaaaccttccatttcatcgttcataatgtttagaatgtgagccggtggaatggcaacatctatgggatcgccaatgcacatttgaacaccacgagtgccgcgttcagttacacgttcactgatggtgtcgtcctcttcaagggtcggaatctctatacgctcacaaatcagttgtgcgatgcgatcaccctttgacactacaaagtcgtcatcggaatggttaaagaggaccactccaatgtttccagtatagtcgcggtccacgacaccggctccgacgtcgattccgtacttggctgccagtttggatcgcggagcaatcctaccgtagcaaccttccgggatcagtacgccgaggtctgtgttgacgagcaccctcgaccgtttaggaatgacgacctcgtgagcgctgcacagatcgaatccggcagactcttcggtagagtggatcggcatcttggcgttcttgctcagtttacggtacttgaggactggggcagacattttaatgatttggattcagagcagacaagatgaagctaagagagctggatcacttgtgcaattgttctactaatgttgccccatttataccaccaataccgtattatcaataaatgtgtcatatagttgcgtaattaattacattttaattgaatgattaatgttgatcaatttaattaaatgacaatttccggtgtgtgctcttgatcagttgttctcagagctccacaacattataccatttcaatttgagatgaattcaaccatgcactgaaccaccaaatcccctagactcattgattttcaatattgattttcaatatagagccaatcaaagagtttacgagtccatttcattaacctgacccgattccatcaaagtgtagccataaacgattcactctagagtaaataggatttcaaacaaatggagacattaaccacgactctatgttttaaactcggaagagtaccagtactatcaagggtttaaaaacaagagtagatgtttgatttaaaaacaagagtagatggttgattaaaaaaacaagactaaacatttgcttaagataagagtaaatatttgattaaaaaacaagagtagatgtttgattaaaaaacaagaagaatcttttgatgaaaaaaatagaatcattacactctttattcaacatttatatttatacatatataactctgctatataaactctactctaaactctactctataaactctgatgaatacaaaacaaacatatagaactctaaataaccctaaatgtaaaatctaaacacaaggctaaacataaacctaattaccaacatcaacagtaaacatcctacaacaatatagacatgctatcatccgagtccaactgaaggctactgccactgctgctactaaccggttcaaactcatcgttgctcgtcttggcaatctttgatggtgacacttcattctcgatggcctcaaagtctatgggctcttcgagggctggatccgagtcctccacagactgagcatcttgttgtatgggcttgaatccaaacaggctaggttgtaccattgccttgtctggtctgatcaacgagtctttgaattgaaacagtacaaagtttcgtatgcgtttaggtttgacgagtgcacgctccctggccctgactcgttccaacagactgatggactggtcagattcagaatcggaacggtcaaatgaaaactcttccgagtacgattctatggtgctagatttgatcgtgtaatctgtactggttgatgtgacagattcagattccgagtctagggttgacttggaggaggcttctttcgagtttaatttagaggcttcgttagagtcattggacggctctttgctctcatcctttgaagtggctttatcctcagaggtggactcagagttgcactctgatttatcctcagaagattctttaatttccgagtgattcgactcttttgatgaagtgtgttttggctcgtctttgttggaatctttgtggtctttaaactctttagactcggtacctgttgatgcaatcgaatctactctatcacagccaatagaatctactctggactctgctttagaatctactctagcctctgctttagaatctactctagactccccctttgagtatcctttataatctctcttcgagtcccctctaacctcagtcatttgcaatttttgcaactgtttacctctctgcacctcgtcaacttgcatctcgcagccttcacgccaagacgtcaaatcgcccattccgaaactcttggcacccttcattagacgccactgtgatgtgggctctataaactcaaagcactgttcattgttcgagtatcgatccacacggttgccgtgttcgtagtagcgcgaacaccaagccaacgattccacccaacgctctacggtgcagttttctgcccaagtcaacttgggattgtccttgttggcggtgcgcttgtccatcaccttggagccaaagtgaatgcgtatcgagtgctgattcttggcatgaaagattaccttgcacacttcgtacagtacggtacgccagtgtttggcctttgacagggaatcgttggttatgctatcaaaggcgttcaacagtgtggcatcctgatgcctcatcatgtagcactgacaaatggccgaaaccatggacggtgttagcaacggttgagtgtaatcggtgcccatcattataacgattgccgaaaacacattcctaggcataccgcacacgttaaacttttgcagattcacgaatcgttcaccgccattgagcagcaggtacaggggagcctcatcgtcgtaccgaccgtatgcaatgtggtaaacgtcactgtcgttggtcacgagtatggtgggtttggtgggatcgcgatccagtatcatttgcatttcgctttcgcccacctccaactgtaccactcggaaccacgactcttcctcgagcatggccttgtagtactgaagcgctgcctgtgcgttaaactttagatttacggcacgcttctttgaagtgtcatgtttgcgcgtaggaggtaagccatcgaagtagattacaatttccgaaatctttacactcaatcggtacatcattgctttgagcagatccaacgcattgtttgctatagtgtgtgcatctacgcatccgttgatgacacccttgaagagggtcaaattgccatccacatgtacagtatactctaggctgggatcgggtgtgtcgtacgagtcgacaatgtactgcttgaaaacgttgttaaactttaggatacccatgatggttgttgggctctgtcagcctgtatactagataccaaaaagtaattggatttctacaactatacactagtttataagccagatagggtaaacactttatccactacacccacatacataatgttgcccatttcatccatggaatacagaccgaatgggtgaatctcaatcttgtagaatttcatacgatgaaaggttgcaatgtaggaatcgatgcatcgttccgtgtccaccagatgcacagtctctaccagattggacacactgggtgcactgggtgcactggggtgcggtataccactgcgtctgagcagaatcgtatagggcactcctcgatcaatgtgtatccatttgcgtgcatttagacgcacacaggatcttgtcatttcgtagacgcaatcgaaacacttgtccgatagcgtagaaaagaacgtggacaggtagcgagtggcatcgggtctagtctgagacatgccctccaggactgtgctaaagttgctgctctcaccggccgagtgctgaaacactgccagattggcatcgtcgtcggcgttgtgcatcatgcacgtatagtgattgatgcagcgctctgtaaacttttccacttgcataggcaccccagtcaggttgacgctcatcagactgttgtagggatcgtttttggaattgctgattgccggcaccttggacatgagcaccagattaaagcccggattcgagacggtcaccgattcggcccaaactatggagcacggaaacgcattcggtggacaccgagtgtacgtgcccagattgagtttggagcgaatcgttgtgggtctgagggtcagtagcgatttcgagtgctggtacagcgtgtcggcaatctgtcgcaattcatgcatttcattgtggtagtgatccaactgtacggcagcatagtatctaaacgtttgcacagtctcatcctcgagcagctcttcatcgtacgaccaagagatgcggtccgcgtcgaccactagatgatcctcaatgtcgtcgattatgagcggctgttcaatgtgtagaatgttgatgcgcaaatgctgcaaatcactgtccacaatcaccagatcgtgatccagagacgcgtacgtggatcgaatcgtgtacgggtactctaccatgagtatgcacggtttgtgcagaggttgtagagtgcccgcatcttgtacgtgttgattgtgtgtaaattggacaataccagcactggtagcttccagagtactagaatcggtacttttaaaactaccattgcttttagtactcttgacaatattggcactcttaacattgtcatcaacagtactctttgagtttccgagcatggcctttttagtgtacagtttgatggcctctgcaacggtactgggctctggcatttcagagttggtaatgggtttggtattgcgatagagttccgagatgaagctaccgttcattttgatgccaaactagtacccaatcctactactactactactactaggagtcctactactaatactactactagtaatcctactattagtaaattaaaatacaactcttgaaaactcctacactaaaaagatatagcctcctcccctcccactcaacgcctcttgcaaccgcagcccaactcttgctcgttttcgtttaccggtacactgcctcttgctcctgtgtccgattctgaagagtccgagtctacactgtactcgctgtcggtatcggtgctttcgattctcttcttaccgtcgctctcaatgtttttgtaatagtctagaatgattgacaaatcgtcctcttgatgatcgtaagccaacagtctaaaagtcaaaagttgcaatagctcaatgtttgaatcaccaataaattgattgaaatcggtgtgcgcaaactcatcaatcagattgtgtcgcatcatgcatcggtagacgaccctcaacattgcaatactgcacaatagcaatcgtaaactttatcgcatacaaggcacacacacaatagcctatgcaagatagagacacgttgaaaaactgaaattaccgtacaggtagtgtaaacatagtcacaataggctattggtgttatcaacttgtgcattgttatagtatgacgatggtttcggtcggttctaatacgggagtctttgtagttttgttgactgttttaaaggccatttgtgattcgtttattgtcatattcttgtacttttcaaatactagttctagtaattgtcccactgtaaattgtgactcgaccactggtactctggcagctagataggtaggcagtgctcttgtttttgggaatcatgtttgcaaacattcaactgaaccagcaacagaattgcgtagtgattgacaatgtaccgtacgaggtcaatggcgacttggagtttttctacaatggagagccctacgtcgtctacctcaacactctgcctctgcgcaaacacaacaactttcaagtgtccgatgtgtacacggaaacgttttcaatcatgcgcaagagtatggccctggagctggctcagtgttttgccaacctggtgcccatcgtcaacattggcctaccggtgaccaagacgtgcaaggctgccctagaggacattatgaaccacttgaacgcaatggtcaattccaacaacgatcccaacaatgccatcgatcaaaactcgtacgcgcagatacaatcgctgatgaagacggtcgccggactcatgaacaaactgaccaactctcagctcgtaacctacctgacgtatggcaacgtgcagagcctgcgtatgacggatgagtacagcaacatttcacagaaactcaccgccatccgacagtacattgtgtgtgccatcacgttcaagccagagtttgtcaatcatcgcagtctgagtctaatgtttgacgtgttcctaaacattgtgggcactctgtgtctgctgcactcgcacacctttgtcgagtaccgcaatgtgcaggatttgataatacacgaaatcggcatcgccatcgagagtctcatctacgaccgatgctccaaggtgctgttcattgacggtgccaatcaggtggccagcggcatgtacaacgatctcaagattaaatatcccgaactgaagagcatcaattctgaaaacgatttggccaaaatcaaacacttggaggcggcattcaacgaggagaatgccaagtacaatgtcaacctgtttccgtacatgctcttttacaacatgtccgatgcggtcaggatccgtcagaatcttagatgcatccatgagatgcgtaaaaatgtagcaaacgatgttgagcaatttgaaaagtttcatcagtttgtcgtcgagtgttataataatctaattgaacccctaaacggcaagcactatgcaacctacacctttgactctatgcaaaagattttcacacatgccatctttgagcaagtcaatccgggtagtctaatgtagtttgtaagacattcatgtactcttgaataatgtaaattttaggtttttctttttttaaccacacctctaatacgctattggagttggctctttaacattcaatgatttcatgttcctacagtggtattgttgtacaatagatgatgcgcactcacaaaactccatcgggcatctttaaggttgaaatcatgaaagtggactcgttggacaccgacactgaaactgagagcacaatgagcaccaccagtacagaaactctgaaatcaaagcccgcagatgccccggtcgcaaaggactcggactctgaatcggatccatcctacgagtccgatgatggtactctgaccgatggctcggatgcgtcctctgtgattgatgtcaaacccaaagaggatccgagtccaccgaggcgatggtggagacggggagtcacccagatcgaaatggagcccgtccgcaataatagtacaacgattccgatcgacgagtctgccagtagtctgtgctcaccgaaatcgcccgagtgcatggctctgcgcaaagtgtacgcaaagattctaattgtggtatttggctcgatcacaatcatggcactcgcaacgattcggtccttccaaacatcggatatgggcgacgatgtactcattcaaaacgttaccgatctcataaaggagagtatcaaaaatggtgtttgaaaaaactagcatcgaaaagtgcgttattgtactagattagacggtagtataaatacaataacttatggcggttaattttatttgcagtttaacagttgagcaggtcactttgctgtgatataagcatggcttcgtccgcgtcctctcacatgtcctttaatatcatcgagtatgggactcctcaaatcaagatggatttgcctcgtttgaagaatccccgtacctcggccgagaacccctacggtaccgagccgcataagccgtttttcgattaccaagagctgatggctcgaaaggttgccgaggtgggtgtcgatacggatgtcgaactcgccgacaccgacaacaccgatatcgagaggcagcgcaatcgtgccaagcgagcctctttggaatcggacagcgatgccgactcggactattcgggcatcaaggtggacggggatcaactcttgcgcaaggccgcaaagtgtgtcaccgaacacaatcgtaaacgtggcatcctggacgccaccgactccgagtccgaggccaagcgtaggcgtcaggttgacgatgagatggaaaactttaagttcttgaacgagcacgttttcaacaagcttgacaacatcaccaagaaggctcaggcggagagtagtcaggaggagccctctgttccggttaggcgcagtcgtccgcagactccgcaccacaagagaaaacccaaggtgcagagtaggcgtgacgattctcaggatgccagcgatgaagacgacgagtgcaacaatcgtgagttgtctagaaatagttttaaccgtagtgtgaatagtggtagaggtagtggaggcaaaggtagtagagctagcgaggccaatagtagatctagtagcagggttagtagcagggctagtagcagggccaatagtagatctagcagtagggctagtagccgaggtaatagatcggacgatgaggctgaggaggaggacgatgaggttaacaatgagggtaatggggagaatgccaatactgaggttaatgctaacgagtccaatgtttcggccaatgttgatggttctaatgtagatggttctaatgtaaatgatgccgattacgagtccaatactattgttgaaaatgttggtgtagagggtgatttcaacaaggagaatcttgctccttccggtaaagagtccaacattgaaacggtagcattgggctcggccaagtccaatattgatgtgtacaattttgatgaggatgacaatgccagtgtcaagagtggtactagtgcatctcagagtaggaaatcaaagaccaagtccactattgctgtaggcaagaatctcgatgatcggcttaaatcgttgcagttgaatttggagttgaccgatgccaataaggggacttctaccaaagggggctctttgttgaatgcaaatggcagtgctaaaaactcggttaagaatggtagtgctaaagggggctctgtaaaaggaggctcggtaaactctaaagtcaacaactccaactctaaaagtgtatccaaatctaaagccaacaactcgtcatctgaaaagaccattaaaccaaaggtttcaaaacctgcacctaatcctgtacctactaaaactcttgcatcaacctcccaatccaacaatcaaacatctaacaatcaaacctcttctcaatccaacaatcaaaactcccaatcttcacaatccaacgagtccacctccaacgattcctcatccaacaactcgtcatccaattctcaatcaactgtagtaaatgtaaacactcaatcaaaagacaatactcaatcaaacaacaatactcaatccaatgttcaatccaatgttcaatctaatgatcaaattaatactcaatctaatgatcaaattgatactcaatctaacacgcagcctaatactcaacctaatacgcaatcctcaaccgctcctaccaaacgtcccactctaatcaatcacgccaacaccaaagtctctgatcgtatgcatgaactcaaactcaaaatgaatccacccagacgcactgacgaggctacaatcttggccattgaacgtgccgctttgacttgtaagcagtgcaacaaaacctacaagactgcacgcaatctgtcaaagcacacgtgcaagcctaaaaagagtgcagcccccaaacgtggcaagaaacgtacaagttccgaatctagtgcatgctctgagccagagaacaagtctgaggcacccgaaaagaaaaggaagctgccgagtacaccgctgggtgtgccagtaccgttgactagtaacagtgccgacaagcaggccttgtacgatgagtttaaagtggtagagccgggctttaagcacatgcacaagttgaacgccatcgatacgcacaagcatccgatagagttgcacgaaacgtatgcttgcaaggttagcgaacttgcctatgcacagtatcacaatgagacgaattgcactgctgccgagtttaagcgtgaaacggcaaacgtgcgtcagagcctatccaaacagattgccagtattcaaaatcagctaaaggacaagtctatggacaaggagcttagcggcaagctaaagttgcgcataaagtttctgcgcgcatacaaacaaatgaagctggccgagtactcttacacgtgtcccaagttgaaaatgtttagcaaaaagatggagcgcatctttactggtaatcgtgtagactcgaagggttctctacccaacaagattaccaatgccgatgtgcagaatgcaatctcgtcaattggcaagatgcaagttgacgatggcgatttgacgtgcatagctagatctttggagaattacattaccctcatcacactgtctgtactggccacgatggtcaacaagagatcgtgccgagtcaccagagccaatatagcttcggtgcttgcactgcagtatgcaatgaaccacgacaaagagtcgtatccgatgccagagcacggcaccatcaagactccatccgatggtaaactgaatgtaatcatttgtcgcaatgtgttggatttgaacaatattacatcggtggaccaagtgatggatgtcttgatggacgagtttaatggggagttgaaaaacttgtgggtaaagtttctattctactttaagcccagcagtgactatttcaaagtcatcaaagagttttacatcaagtacataatggcatcgtatatggctctgtgtaagatggaggaaaagagggcctctggtaagcccagcaactttagacagtgcatggccattgtgattaacaattgtacatggttccccttcaaggactatgccaatcataccgatgtgaatctggaccgacaggccgatgacttgtttgagcagtgcgatgtaaagcgcagcactagcagtgccggtacgaaacgcaaagcaaatagagccaccaaagaggtgcccactaagaggcaacgttgcgatagcagcgacaatgagtctgttgccagtaggtcaccgagtccggtaaagcgtgcaccggtacagagttctctggtcaacaaggctctagccaacaaggctatggtaagtgcacctatggcaagtacgcctctggcaaacaagcccactacaccggctgtcaccaaaccaaagagagacgatatgatcgagggtggatactttccgatgagtcgagtcgttaaaattagaaggctcgaacagagacgtatggaggcgaatgcggcaaatagaggtagccttaactctaacactaactctaaccttaactcgaatcctaactctaactctaaccctactcccactaacaataccgattccaatactaacagtgctaacactactaacaatactactaacaacactaaccccactaacaataacactaacaatgctaacagtactaacaccactaaccctaccaacaacactcccaacccttctaacagtgctcccaaaaagcgtacaagtaatggttcgcgcaaatctagtgcatcgtcaaagattgaccctagcaggataaagtctcgagagttgattgagaatgatgattttagcagtgatgagaattagagttggtctttgatttggagttttgattcatacttggatgtaatttaaatcttgtagttgatcttgtatttagctttgtattcaatcttgtattcaatcttgcatttagccctgtattcaatcttgtatttagtcttgtattcaatcatgtatccctagagtataaattggtataagtttcaatgtatccttagaatatacatttcaatatatctttagaataaagtcaatgtaacctcctagagtataactttccatgtatccatagattataatcttcactgtatccctagagtataagcttcatttatccttagaatataagttgtattactagatataaaatgattaaaaataaataaaggtatattaaaaaatactctatatttttaaaatgtgtacagtgtaatattatagcatctagtatacacgtgtagtataccaagtgtagtgcaccaagtgtggtataccaagtctgtgatatataccaatgaatattaatcaaacttttgtatatactagtattaagtattcttttttagacactctacttggacatgtatacttaacactaacctaaattactacttgcattttaccacttgtataactcacaatctacaaaattataatctacaaacttacaatctaccaactagtacaaattatgactttaaatctaagactgagttgaaactctaaataaatgatgaaacctctaaagatggactctttgatttaacccttatccttgttgcatacactgaaccctaaatccaaatataacccctgattcttaaagctactcttaaacacacaacttggcgcctacctttaaatgcatagttttgtacacacgtgtacaatgtatgaaagaaaccaaaaggcacaaacctttgttgtctacacagagtacaacagtttaaacttggcacagattgtaaaccgtttacaggccaacgaactcgtgtatgtgtaatggaggttgtggtcttgaacttgaaccgagttgtaaatggagcatagagtttgcgcagtagagttttcatagagtaggtttgtgccttgtgtagatggtgttagtagtagtatactgtagtattatacttgatttgatattttttaaataatacaaaaaacaatacttaataaatattataataaaacaatacttaataaatattataataaaaaaaacaatacttgataaacaacatctacataacatacaataccttttactaacatgcaatacatttgatacaacttggtctatgagtattctttgaaactacatttacatttaggtacatttacaattacatcaacaactacatctaaaactccttttcaaaatccaaagccacactatccaacacttcaacatccgaatctgtgaggtctgaatcggttcctcctacacaaaccctatcaacgcctactgatatgtttgatgcaacacactcggtagacacttgttgcaattcctcaagcttgcaacgtttgctctctggctgagaatctgaatctgaactagaggccgagtcgaacattacaaactctgccgacttgaaattggcaccagtgccgtactcttcaggttgcgctgtagatgccgagtgttgctctggttcaggttctactgttgacgccaactctcgttccaattccaaatccattttattgacaatacctttaccactgacctttctcttggagccagcctttaaagactccttctgagctgtactctttacgtattgtaaaatgcactcgttaccttcgtcgtcgtagcacaccacctcgtcgggatcagtcttggccttttcgtccaaccgatcctgaggctcctctttgaacgtgcacggacactgtatggtgtcgtgcagctctcggcggctcttgctggtgaggccattaaagttgacattgtccttgatgtgtttgtagcaatctagcaacggtgaagtgtttgtctgcaaagagtctacatactccttgtacgtggttctgagcactcgtacgcatcggccctttgatacgcgaaaagcttcaggcgtcaccactggaaacgttaccgtcttgtacagataggccagcacagagtttaccgaaatgattctctgattcaaatcgtccgtggtgattttgtacttttcacacagattgggcacttcgggcaccttgtagtagtactcgtcgtttttgacgtgcgtgtacaccaaactgcacaagtcgttggtgtgcaatcgcttcagtcggaatccctctcggatacgagtcaggcccacgtagactgcattcatggtggtatcgtccaagtccagttccatgtcacacttgtccagagtcaatccctgagcgctatagtaggtgttggtaaagaatcgcaacgggtactggtagcgagcaccctgcgacgttagccacactcgtaaatcatcaatggtattgtaggcgtttactgcgatgcgttgcaagtgctccaaacgaccgctagagtttaccacctcaatgagcgtaggtgacactttacgcacaaactgtaccacgtcctcacacttggaagtctcgctgtacttgatgtacgagtagccctgtatgagtacgagtagcggtgcaaacttgtagttttgaggcaacgctaccgcttcaaaggagcctcccgctttacgtctacagtactcggcctttactatggtgcgaccctctttgacgctctccttgaaacatctatgtatccggtccttcatcttgcgatgagtggccgtcagaaacatggccgtctggcactcgttaatgtgaaagtgtctatacagcaaagagtagagtgtatacttttcatggaaatccatgcgtatattgtcgtgcttctcgtccaagtgcaactctatggtttgtatgattttcaagtagtcggcatcggtgatgcgcatctgtttggtcagcatcagatcgaacgaggccagctccttgagcagatgcatattgttcattttgtgatagaccgaggtgcggatggccttttgttgattggcatcgcccaccatcaaaatgttgagtttatactgcctactgagcatgtgcaggaatataatcattagcggttgcatgaccgtgtactcgtcaaacacaatgaggtacggtatcgcgaaatcgccatcgttgcacggcaccatcttgaatgtcttgagtaatttgagtagatcgtaaaatatggaacagatcgtctttgactggggtgcgttaaagatgcacttggcctggttgtacgagagtcccagagtgtgcataataaaattgcacgtggtgcgagcattaatgtttgtgtgcagagtggccgcatcgtctttgagcgcattgctataaactacaaacatgatgggtgtgagcaacgaacacgccatgacacccataattgtggatttgcccgtgcccgatctagagtttagtacaccgaaaaaggagtcttctatcgagtgaatcttgggcggtgtatacttgccgtctagactctctggtacgcaggatgccgtgtccaatctaaagctatcgctaatctgtttgtgtataatctgaaaggcaaccttttgactagagtttagacagtggtacgcggcattggtctttcggaggcatgcaatcgacatggagggagtcgcgttctcgtacggtggatagtcttcaaagaaggcgatcggtttgtttagaatgaatcctagaacgctgtctggcaaatcgttgactccgtttgtaatcatgcgacatccctttacgttacgctgaccgttgacgatgcacagtttggccacttgtacaaaattggcccgattgatgcgcgtgtcgggagtgttgattagagcctttaattgatctacatcgtcttgtgtaatgtcacgtttacgcaccgagtgcagtaaacgtacaatttcgataacgcgctgagaccggcttagtgacgcattcatggctgtataccactagtgtatataaatatcgaagtatttaaaatttcatttagtacaatacggtattgcaactataacggtattgtctaacgtagaattgtagcatcaagtaaactagtactaccaactttgtattcatcatgatgaagacaaacattgaatctgcactcaaggctcctcagaagaggccagccagtgccatgatgggcaacaacgtgatgcccagtgcgagatctgtagatttgcaaagtgtcatgggagactcggccaaggttgatgagagcctctgggactcgtcaaatgcggtccctgcggcctctgccgaaactgtagattttgccaaaaacattaaactcatcgagccaccgccgcacgtgaagcgcatacccaagtttgtacaattggaagatttcaaaaaggccctggtagagtttatcaaggaggagggctcgtttgaattgaacgatcccaatcacgagactctgcatcagttggatgtggagcatttgtttaccgacgagggcaaaaaggccaccaaggtactgtaccatgccgtagagtatgtctacaagaatctgtacgaagacttgattacgaatacgggtgatttaaagtttatcgaatggtgtctgcactttttatcaatctacacggcagacgccattctcaagctaaaagagtttataacgattgcgaccagcagctgtggggactcggtacgcgtagacattaaacgtccctgcctgggtaggtttggtaaaaagtccaaagtcagcaaggatcagatggccgagatgaatcgcaaagaacgcgtagaggcttggctcaaaatgatcaacgatgcgtttggtacactggacgagacgtgcggcaaggtgtcgtgtgtcagtgaggagaatctcaagtttgtatcgatgcagtgtaaaatgtccaaatttgacatttccaacgttagcgtcatgggggctcagttcaagtttggtaaacgcttgttcatctttaccaagatgcacgatgcggcatcggcgcagattctaacactggagggtgatgccagggacatgattgtgtccagtgtaaacaaccaagtgaccggtgtagatttgcgtctatcggacgtggtcaagatttgtgcctacaagaaggttcaaacactacaggcctatcagcgtgccaagaatggcttcatggtaaacgatggagttcgcaagtctggaaatgtggccattctgattgattccataatgttgtcgcctcagttgtcgtctcagtatggagatcaaaacataatcaaactgtatccgctacgagtgcaaaaggtggattgcagcatgtttgactttacctttgacgaggacgatgatgatgaataggatggagggtttttgtattcagagttgtatttgagtgtttttgtatggtattgtattagagtagttgaatttgtatgtattaagatttgtagagttgttgataaaataagagtttaaaaaaatatgtattctgtaatatgtattctataacattagtattacttgaataaatgtagttttttgatacaatagtatgtctttatataatttttaactataattttaaatataattttaaatacaagtttaaatgtaatttttaaatatacttctaaatgtaatgtccatgtatggttatcaataaaactcaaaactctaacattattttttaatctctacaaacgtgaacctctataacaaacatccatctctaccttaaacaatccaacccactcatcctatccactcagcctatccactctcctctaccttaaacaatccaacccacctaaactagcctacaacaaatgtgccaccaactggtccctagtcttgatgtagtagtctgcatagattcggtactcgagctccgactctattgaactcttgtcgacattggtgaatctgtaaaagtctacatatagcgcagcttgatcatcattagtcttggtggtggtagtagtagtgttagcatcagcatcaacctccaagagtgcaccggcatcctcaatgtgcggtattgcaaagggtagtctaccggccagttttgtcttgagcgattcatcgaatcgtagcatgtcttcgtcaaagtttaacaagcacactagacgtttacccagaggcgatgtgtgcaccgaggtcacatagagtgcctttagcacagtcataaactcgtcgtctctctcagagggcggtgtcgaatggtacagtttgaccagttccaattccttgagcctaaagaaggttgcatagtagagtgtcacgtccggtgtgttgccgcgtatagactcgtaggcatacctcgcctgttccacatccaccggcagattgttgattcgattacagtcaaagagtacaaacttgacgagttcattggcagcggaaacttcatcaaattctgtacgtttgtactttttgcacaaaatgttaaacaggtacgatagatcacaactcttgcccattatagtttcccagagtcctttgagtacgagtgcagcatcgatatcgcccttggtacgagtcatggtcaattgaacgttggtggcatctttgatgttgtacggtgccagctgcagagccaactggagcacttcaaagttgccaaatctaaacgtcaactcgaccagtgtctgggcgtactccatcagggcacaatagtcgtcgctggatatcttgtccaactctgcatcgtgctcaccaaacgttacaacggtaccgtgcgtcgaaccgtgattcaacaccagatcgggtcgcgcctcttcatcggtggcggtggtgcgatcttcaaacactcggttctcgttgagcaagtgtatagtgtttttgttgactctaaaattcaaactcttgttgtcctcttgggaattgtacacttgtacactgtacgtgcccacatcgggaaaacactttacaatctgattcacggtataggcacacctatcgatcaccatggactcgggcgctcccttgacgatccttttgaaaatgtactcgcaatcggaccgggtgagtttgggtttgcactttagcaaggcgctgttgtagtctacgctcagaaagtacaaaaggctagagtagttgacgttgcgctcggtacgatgccctctgggcagattggtaccgatcgcacgcatcagtccgtaacagtagccgtgatctagctgctgagcatctgcattgtctaggaacgcgtccacgtagtctgaatcgtagctctcggtggcatcgtccaagatgcactcaaacttggagagagtgcgatcgtcaatcgatgcagtctgtcggtccagttgaatgcacttgtacagcacagccttgaacattacgaatcgtgcactggccgtgggcagggctctaacgccggccactgcagtgactagggacacgtttggattcagcgtcagatagggaccgtgcaacgattccggatcgtgcttttcatcaaacacatagggtaatctatagttgagcgcaatgtctgtacaagagtcggcataaaaggcaggtgaagtattcttgtttttgtaggagcacttttgaacagtgccaccctcgtccgagtccaaggttacgtttgcaaggcacgagtacagattgtacaattccaattcattcaaacgtataggagtctcttggtggaggttggtaatctcttggatcacggcactcgtatactttgccagattggatacttttagtgggtactctagagtggaggaggttgtatcgtgcaacgactcttttaagcgttgcaggatgcctactaggctggctctgctctgggccagtactcgcaccagtagccgattgagtgccagtgtcggtatggcatagtgcctagtcttgctcaatcggtacatgtcataattggtgggatgcacacccaccgatgagacgagttcattgtacctgactcgatgctcgtacgtgtgctgggaatactgggattggttgtgatgttgttgttgttgttgttgttgtagttccatttgatttgtataggtaactctatagagtaacgagtctacaaggttacaagcttagtgctagtttaatatcaaactaaatacaaagccgtgtcggtgctttgcattgctaaaaaaataaaacaaggttcggtgaggttgtctcaaaaataagtaaacagattctacttttgtataggtatttattaaagagttttagtattgttaaatatgtcaagtattgttaaactatgtcgtgggtaatctatctatccatctatcaaagagtctactgtcaaaaatacaaaaatgtttacagtgtaatacagtacaatataatctaaagtgtaagaaatcgaaatctaataaatctaaaggtaaatctaaagacaaatctaaaatgtaaatctaaagaccaaatctaaaatccataaatcaatccattacacgtgcactccttagccatcatcctcctccacctctacgcactctttccagtcttgcaaaacagcttccaatttgtctgctgcgtaaagtacataaacagagtcagtgccaacaggcagattatggcaatcttgtaaaacagtgtaagctcggcaaatatcaatataatgattgatatggccaccggtacaatcacgagcgtaggatagcaaaactgcgacagtattgtagttgtggtcacttccttggcgggagtttcgctgggcacctttgacgagctaggagtggctgacatgatgagttttctcttcttgtgtaaaactagacccttttcaactaggatgctatccatgaataaatgtatcaaaagtcgtacaatgcatgtgtctaaaaaatacaacgggtatactttattacaaaacacactatatacaattttcaacatttttagatacaatgtcacgaatctcatcacgatagtactcgggtatatccaacggctgatccatgtaggctcgttccaaaaactcggtaccgatggccagatgccgattcagttcacgaatgataatctttgcaccgagtccgtccagctccatctccgattccacctctcgttccagcttgtacgagtgcctgccgccctgacactgaatcatgtgtcgcacattgccatcggtgataaagtagtagccgattgcattcttggtgaccaccatcgattcggtgggctcggccagtttcatctctcgagacaccttgtagctgcacttgaggtactcgtccacattgtccttgtcctcttgcagtacaatcttggcatcgtactcaatgttgttattgtccccattgtacagagtcttgcgcacaatgaccggcaccgaactatcggaaaagtccaccattgtattgtagtaggtgcgatccatcatccgaatcggtgcgtgattcatgtccaaaaagtttctcgtagcatacagcgcagagagcaccgtctccagcgacagctctggatactccaatttgcgcttcatggtccactcaatctcttgcaccatgagcgagtgtgcatcctttgcagtcaaagtgtccgtagacactcggacgctagaatcgtcaccgacaatcgtaagaatcatattgttgcaataaaaacaaaggctagtacaaagactaatgcacacgaccaacgcgaatgcttgataaaacctgaatgaatttgttcagtttatatatgctccatttaaacacctactagtgattattactgcaatacttgttatgcgtttaatttcaatagactattaacggtatgcgtcaacgatactttacagaaacaacatgcagatgcaactatgaacgtgtggatatcgtttagtaccatttttgcgctatcggtggtgaacattgccattgagagtgccaaggctcgaaataggataaatttgtcaaaaaacaagtttgtctacaatccatctgagcgacatccgttgttgtagcatcatggattgcaagattttgtccggtgaagagttgaccaaagaggctcaactctttatcaaaaacatgccagagggtttcactctgacgaatcctatgcaattgtactatggccacaagattcaccggtacgcttggatctctacgccaccgttcaagtttgacgaaaagactatgactcgcaatcgcaacggtttgtttataaacctgctcaagtatgcgagatctctgtatgcaaaattaaacattaacgtggtgatttactacgagtctgatatgccgcctctgtttatgggtaatgataaatcaatcgaagcggtaatctctatgattccagcataccgtctgcgagcagtgacacatgcaacttggaaggataaggattgattggagggggtactcgtacaattaatgtagagtcaattagtatagctaatagatttagtttaacatttgtatcaattatggatttcaagattttataaagtgttttgatgaataaaaatccttgttttttagtaagtcaactctttgagttcaagtcttattttttacacaaaccaaaacttgaacgcaccaccagtgcacgctgcctcaatggagttttttaccattgcatcgctcgtactcatactggtgtgcgtgacctacctactagagtgtgcacgcaagagttttgaaaagtataacgatgaaacgaaaaagttttcatggggccgttataaattcaagattagcgaaatcgaggccaagcacacggaatctaataaagattctaatttacaacccagcaacactgtaacaaggtttaaaggcccctttcaaaacattaaatacaagaacccctctacagatcccgtaatcatagatccgggtcagacgaatctttacgagtgcactccgagtaaacctaaagaatgcaaattgtccgatgccacttcgtgcatgggctgtaagaatctgactgcacgatgcgtccacctaaaggaggacaccgactacacagacaccgaaaccggtcaagagtttaaactggccaagagcaagaccctcgacgacggttattgtctgagtgtgaaaaaggttgtagacttgtgcaatcccaatcacggcaaactggcactggtcttgtacaatagggacttggacgaggaggcctacaacgagcccgaggatgaaaatcaaatattctacaatctattgtgtgtctgtaccgagccgggctacgtgggcaatctgggtctgttgggttcgtgtgaggatccctttgtgtgcaacggtaaggttgtagacattaatgtacccctcaccgaaatggtttgcgagtgcggtgacaatttcgagtttatgcgcatcaacggactgccaacgtgtcagattaaatcgatagacaacatgacaccgaccaccgagcccatagtgcccggctctgtatccaaacagaggtaccacaaaacgatcgcagccaactacaccggtgagagtctaccgaatccgtgccgagtgtgtcccgtcactggcctagtggtggacggagccatcattgccggcaaggacggtagtgttcagtgtcagacgtactcgcaacactatggagtgcccatacgcagattcaaagacgaacgcctactggcaggcgatgagggccccgatgcgattttggccatttccaactacaccgtagacgtgtacggctacctagaggacaccacctatcccacgctgggtataaactttacccgagacgacaacaaagagtttttcgatacgctcaagattgacaaggacgagtacacgctactgattcgaccctatcatcaggtaaagtttccgggcaactttaagattaccgatcgcctgtacaaggtgcccaatctgaaactgtacgagtacacttggacgtacgatttcaaattgcagaatccggcccccgagtctagtggttttgtccagtacctggatccgtacacgttcaatctaatgtacgatatgctgtccatgtactatctgtggggtcggacgtcgtactatacagtcatgaatctgaaaccgtttgtcgtgctcaaaaaggtcaacggtctcagtgtgtactcgaacaataagaatctggcaaagattaacgacgaaactatgaagctccgattcctattctttagatttgacttttcaatggatcgatcgctagtcatgttgactgccgagaatcgatacgattgggacaagtatcacgcattgcgtataaaggagggtgaatgcggtggacgaatcgtacgcggtgaatgcatagatccatttggtgtgtagactgaaaattacttgaatgtttaaactctttgtttacttgaaatgttaatgttggtatttgtactagtagtagtaatattgcaccattaattctaataaataataatagtaatagcttattagtgttgtaaaactatagaatatagtagggcctttgcaaactttacgtgtctataggtaaatccagacattttattactcagctttaacttttaacggcatcatgtacaagcacattaaaccgatgcaaagcaagctgcatcagtccaacaaattgaatcagcattttataccgacacctagacctctgaccgactacaagtgtatatgcacagaggcgctggaaacgtttgccgtagcgcctgcgtccaaaaacattgcactgcacaacgccaccattctttgcattctgaatgcgtacaaacagtacgtgtgtagtcgcagaacctttctgtccagagaggagctgcgcgagttggatcggtgcattcaggcggttcagcacaactttaatcgtagcgtgtgtgtttcccatttggattttgaagcgtccgatgtgatgctttgcaatacgagcaatagccgagtccgactgcccattgtgcgtactccgaacaatgcacagtcggtgtgtcaggctgcggccacaatgtgcggtcaggagattctcaagtttgtaatgagccattccacacccaatgccataaaattggaaaaggcgcaacctgaggccagtgagaaaaagattgatctgaagcgcatagccgccaagaatgatggtggtggtggtgacaatggcaacattacagtgatcaatgtgcaacccaaactggtacaattgatgaagagtgccgaaggcgatattgccaagttgacggctttcggttagggagtgtgtttgagagatttaggttttggggttgtaggatagagttgattgttgtaggttgtagttgtaggatagagttagaggttgtctcctagagtgacgagtagagcaatgtgtgcgtggaggttactgtttgattatttgtgtaggagtttcttaaatgtaattcccaattaattttgtacttgggttaaagatttgtgtattttcaatttgtgtagattttaaattgatttatatagaatacctcaataaatacaagattcttgatttgtgttttttagcatctaaacaaaaaagaacatttattacacctctctgcgacttgcaagtctacagtagcatttattcgtgaccgtaaactctactttacaatcatataattaccatagctcgggtaattttacttggaacggctctttatgcaaacaacaaatattatgccaatttaaagcaacccatgaatggggcaccataattgtgtctataaaatgcacacaagacttgagggtaataaaccgaatgctgaatgcagattgtgtgtgcatgtttggggtttaaaatgaaatgtgaataatgctcggattaaatggttttaaaggattttgaaggatttaaaggtttttaaaatatgttgcagtagtataggataggagtggacgtagtaaagtggaagtagtagtaaagtgaaaagatgcatttacttttaaatgtttattttttaaataacaaaaaaaatactttattgtttaataatacaaactatgtagtagtgaacattaatgcttatatctaaagtgcagaataaacacaactctaaagtgcagaacaaaccttaacgctaacctaattctaaaatacaaatcaaatatgaacttgacatacatctcaaacctcaactctaaaacacaactcaaaacaaaacttaatacaaaacttaaaccatcaaaacaatccatctacatgtgaaaagtcagcatccaaatctttgtacgatcccttactaatcccagattcctctctgtcgatatcgtgttcaataatagaatcatgcacaatccttgaccttttcggatcacaatcaaagctcagtttgcgtttgcactttaaatttccaacagagtgccgtttgcgtttacgtggtgcatccaacaaatttaaaatctcttcatcatcacacaactcaccctcttccagttccgagtctacataggaacgtttgaccgtcttggatttggacttggacactgatttggttttagaccgtttagatgaggtgtgtctagttttggtctcagtgtatgtgtattcaaagtcctcctcctcttcatcagctggcacatcaacaggccacactgcctgaatctctggcaatctgcgattcagttttggtcgagtgattggattcagtttgttaaaatggttgttgtggttgttgtggttgttgtggttgttattgttactattgctactcttgttgtactttttataattcttaactttaaaagttgtaggataagtctgatttagagtgcaaggcttggtgtacaaattgttattattgttgtggttgcttttgttgttgttactattgtacgagtgcttaaaactcttgtagtgagacctattcttgttcttgtaaccttgatgcttattcttgcaattggctctgtatgtatccttgtactgttgtacactgtcctcattattgtcatcagcatcatcatcataatattgcgtgttgttgtattgattagttgcatgctcaacctttgaattgacccatttagaattaccataagccttattatcataacaatgttcagcattagaataaccagtagtggatcgtctgcgtttacgatgcaactcgtcattgaactcggcgtgatccttgtacgagcggtcatcgcaatcgtactcttgtttaccgtagccgtcctcagtgtggtactcgcgttcgacagagtgctccgaaacgacacccttggtggaatcgtaaaatggtgttttcattgactctttgtcattgtagcctctatggtttggtttggtggtacagtgctcatgtttggattcatacgagtggtgtctagagttagatttagatttagatttagaatgtgatttggatgcagaatgtggtttggatgtaggatgagttttagagtcagagtagcgtttagagtccgagtgtaaagagtccgagtgtttgtaatcatgatatttatactctgagtgtttggattcagaatgtttagaattagaggttttagaatatttagaatcagaatgtttatattcaggtttacaatccgagtactcggaatgcttagttttgtcacttgaactctttacacttgggctctttacacttgaactctttacactagaactctttacactagaactctttacacactttgaatgattctcgatactagcatcactctttggactctctacaacattttcataatccatacatttagaatcgacactacctttagaaatgctacactttgactcgctacctttagaatccatacccttggaatccttacaatcgacattctcaacattggcatcctcagtgtaatcaacctcagacaaattgaccaaatcatcatcctcagctagctcttgttccaatgcacactttaacatgtgcagtggagtgtctgaatctaggctatagtctaggctgattgattcagcgtcagattgtatcggctctattggcaatggtgtagaagtgttgcatggtggctctttcaaaacattttcattatcctcttcaatgggtttaatgatcgactgtggtctatcatacttgtaaggtctagcatatcggttattgttgttgttgttgtaaaacttggaattgtaattataaccattagtattgttattgttgttgttgtatctacgattgttgttatagggcgccttgtacggtgtaaaagcagatctgtttggtgctttgctaatggtatttttgtaggagttgtaattgttttgattttgattaaaagaatttggatgattgaatgaattgttaaagttgggggtgttgttgtagttattgttgtagttgttgttattatagctactgttgttatagctactattgttatagttgttgttatagttattattatagttgaaattgctattgtcattaaaaggtgcattattaggatagttggtgttgctgttgctgctgttgttgttaaatggacacggatagggattgttattgttgttataataattgtttgaattggaataaaggtttggataagtgttacagttttgatagtttggaaaagagttgttattgttgctattgtaattgattgaactaaagctgcaattgtaatcgttgcaagagcaaagagtcggttgcatgtagttgacattattaggatatccagaattgggaaaagagttgttaaaagagttgttaaaagaattaaaagaattgggattattaaaagaatttggattggtaaaattgttaaaagagtttgaatcaaaagagccaccattgcaattgaaaccagaattgttgggatggttaccatacctgtttccacttttaaaattgttaccattgttgtagctgtagttgttgtaattgtacgagctgccacctccattgccattgccattatagccacgataacacaatcctaaacctgaaccaactcggccaacaatcacactaggagtctcgatacccttttcattatacattccatcattgcacttttcaatattgtacttttcatcagtatcctcctttagtttatcagccagattggtggcctcatcgtccacagtctccacgtccacattgcactcgtcttctaggttcttactcctcagtacactgtcgccaatgtgcatgcattcgcccaagttgaatcgatgcagtatcgaatgaaacacatgtcccactcggcaatgaacgcatcgattgcggtaatgaatgtccacatcggggcacggatagttgttgaagcagcttccaaccagtgagactttgcacaggtacagcttgctggcattctccacaaaggtatcgtaccaagggtagccgttgctctgcaccagattctgagcatcgtagacgacaatcagatcgcacgacttgatcacattgtaaaagttgccatagttgcgattggtcatagccacctcgggatggttcatcgtaacggtggcatagtcctccatgcgctccacgagcatggtacacttgttgtacacgagcttggaaaccgaggctccggatgcaccgttgcagatgcgattgttcaaacacttggacactacggaaaagacaatcattgcgatcctgactcggtgacactcgtccgatgagtgcaccttgcacgtttccagtttggacatgctctttaggtgctcgttccaagtggcgagccattcagtcttgcgattcattgccgactcgtcttcggcatcgacaatccaagagactccgacctcgctcaatttagactttagcgtttcgtttagagtttgagggccgacgatgtagtcgattatgcgctctccctgataggtgggatacgctacaatggaacgagtcacattctccatcatcagttgcttgagttgccgcagcgattgaatcgactcgatttgacgatactcgaacgcattggctgcattgcaaattttattgatcctctccaactccacttcaagagtaatgtttacatcgtcgtcagaagaggaggaggaggatgaggaaattgtagaggattcagatatagaggccatggttgattcaaaagccaaaaattaaattgaagcagacttgttgtcttggggacttgcaccacaccactggtactgatagtggtcgtgcaccgtacttttaaagcttatctctactacattttatgttgaaatattaacaatacgctatgggcaatataaatagcacaagtttataagttgaacatcaaacgttgtacgaacgttctacagtatacatctatacatatactaataacaagttgaaaaatgtaccaatacacggacgttgacgatttggatctcgtttcgagcgaactccaaccgagcctaattgtgcgtcgtaaatttgaactggagcccaatcggtccgtgtatctgatcaatcggtactcgtgtgtaaagccactgaatcgcaactatggcgaatacgtacataatgttgtcgaatttagagactgcgacctagagtatggtcccgagtgcctgcctccggctctgcgcgaagtattctaccatgtcaatttcaagtatcgctcgtttaacgtactgcacccaaactcggacttgtacgcgctaatgtgcttctttgagacggtggttgtcgatttggaaaagtgcatcgctgccaacgatttgctgattgacgtgtcgcggatccttcaaacgcttctggtcaactctaaactcaactatacgatagacacaatgttcgggccggtgccgtggaacgatacgattttaccgattctatcgatgccgctaccggcagagtctctggttcgttacaagattgataggccaaagattagcctggggcaaactcttcccgaaatggatattgacaagatttacactcgcgactatttgatgagcgtaataaagacgtatacgacgggtggcgtcggcaccgatcgcatcagcgacgacactctgactagattcgtaaagcacactaaaaatatatcgccagctttgaacggtactgcgtgtgtgggcaagagtacaattctgcgcaatattacaagctgcgctcaaaagagcctgggaccagattttgacggtaccgtgcaggtgctcaaactgtctcagtacggtggctttaaggacaaggacattaacgatctcgtcggtatgcaatgcctgccagtgttgatgcacgcctgcgaagagtactctactagcgtcacggataggtgcgtctttaacaatataatctggaaactcatcatgtcactgtttgacgcgtcctctgatcaagaactgatggagggcgcctacaaggcattgcacacgctcaatctgaatctgctagagtttatgaaaaagtttcccatctttgtattggtcgactcgtcgatactcttgaatagaaaacgcatgtttaaccgaggcgttgacactctggagaagagcgaaaaggttaccggtgacttgtttcgttgcaagattgtaccgtatgtcaaggctcagaatgtgatttatggcacactggccacgctgtgtgactggccagtgattgatgtcggctacaagtttccattgaccgcagattggatgtctatactgacgaatacgttttgcaataaactcgttgaaaactacaaagtatcaaaagctctcgctctcgccgacaacataagccgggattttgattgtcgcggttcctacattgaagactcgtacaccagagactatggccaccgtccaatggtggacgagtccgaggagccgccagccaaacagtctagactggacgatggctctgccatgcacaagtacaatactcgcagcaagccctttcaagaggtgctcgtaaagagcgaggccaagagtgtcgagatcaaaagcaacagtagcaatcccggcaacggtgcatcaaagagcactcagactagcaccagcagtaccagcactgcagactcgcagagcagctgttcctcgagctcgaccgattccgaaatgaattttaccgaaacaaccaccgacactgaagactcggacacttcaatctcagaggacgagtccagcgtggccaccgttgtgcccaaagagtccaagacggatgtgcaaaacaagatgcgcaactcgagagtcgtttacaaatatagacactctgagtatccgattctatcctatttggcagcaaaggcgatgaaggttttcaagtaaattgtactcgtagaaatttgttatgtaaaagcaatattattgtaagcaccaaatgtacatgtttagtattatgtttgattgtttgcatgcactctatgtatttagcaactattcttaaacctcttgtaaccttttgaaatcaataaagtctagttttttaagcactctattgttgttgtaagttgaattgatgaatggaaataaatggtaaaaaagtacacaagtctttgattgctttaaaagtatcaatgtaccagtaccaacactaataccgtattggtactatatttggttgaaagtctaagaggcgccatcaaaatgaattgtgcattggtaatctcgggatgtctcatcggcgtcgtattgggctccatgtccatgcacgccattataaagttgctctttataatactgctcctgtggacgacatggactctggtgcagcagcacacaaacactctgagtgattggttttcgtcaaatgtaatgtctgtaatcttgactaagttgatgccaccggccaagaccaactcggtgaagccctttaaactatccacacccaagactcgaccagagagcccagacttgagcatgggaccaccgcccaaagattttgccttcaacacggccgtaccgttgaacgcaaagcccaagtctcgttccagatccaagtctaggggtgagagtacagagagtgaggatatgttgttgtagaggtttttgaggtttactttagaggtttactttagaggtttactttagagggttgtgttagatgtagtttattttaaaggttaaaggtagaggtttgtttagataaagtctactttaaaagtttgtttaaataaataaagttgatttatagagacgtttgatagtattactttagatgacaataaaatgtaactgtagagtttaggcataggctcaaattcaagttgttgaattcttgttttttaagattaaacatttactcttggatgtagaaagacttgtaaattgtacctttatttggacatggaaaatccatctaaagttgaatgtatgcgtgtttagtttaaaacatagaaagacctagatattgttgaactctagggttaccgataacaacgtgttgaattggtataaacattattacgcatagcgtattatctatactcatccgtgcaataaatacagtagacttgagcggatagtcatcagtactggttgagccactataccggttagagtaccatcactaccaagtactcgtaccaactactaccaactactactaccctctacccatctatacttgcaattttcaagctctaaactctaaaccgcaccatgtcctcttttctctccatgttcaactattcggcaccttcaagtgcaccggacaccgaactgccggacactatcgatcggtgggtcattctaaagattatcaacgacactcggcacatactagtggatcgattccgtgtatctggagagtgcgttgcacgcatcatacagtacgtggacgatcacattggcgatcacgtttccaaggagcgctttgaggaccacttgaccgagattaagagcatcatcgcccaagagtctatgctactgggctcgttggccgatgcctttttgggctccattctaaagagtaagattatcgaagtgtaccagtctacgaaacgcaaatcgcagagtggatacgtaaacattgacagtgacggggaagagattgaagacgaagaggatgaggacgatgattccaatgatgttgatccagatgcttatagagggcacaattcagacgatgatgatgataatgactctgatggaggtgccaacggttctagagatggtaacaatagcactgacaacaagtgccagaaagagtatgaaaatcaaaaagagtcacagggtaaagaattcaagggtaccgagtcgtcaaacaagcgtcgattcacctctgacgagtacgtgtacaacattaagcgtttccgcagcagtgaggaagagtttgaatctgaccaaatgccgaatgcgttggatttgaaggactactatggtgacagtaccgatgaatccgagtctgaggatgaattgaagactctagagcacaagccaaaggaggtggatatttcaaccattcttccaaagggttaccgtttggttgataacaacaagttgattagagtcgactactataactttgtgaatgagcctacggatgagcctgatgaggagtctgaggaggaggatgagaatgaggatgaggataaagtgtttattagaacgtatgcttcaaatgtttaattgtagagtatggttgcataaggtagagtaaggtgtgttgtagttgtaagatttgtagtttgtatttgaagggatctttaaagtttgtgggcatctaaagtgtaattgtaacaagtgtaattgtacttgtaattgtaattgtaattgtaattgtatttgaaattaaacttgaataaaaacactatgtgaattgtagatttttgtattttttgtataccaaaaaatattaataataatgaatacattcctaaatacacttgttgaatacattacctccacccatttaataaatacattacttaaacacattactaaaggctctacacaatcatataccttaactagctaccactctggatgcaatataatcccactccaaatacacattatggtaatctcccccagcatcactacaaatactataatgaccaatcttcggtattggtgttggctgcttgcaactcgtcaaaagtcacaacgccagcctgtctgagtgtaaagctctctagctctctgagcagtcgttccaagtctcgaaccgcctcagtgtcggccatcgaacccagtacggtgagtgcattctgcagcttggcaatggtttgaatcgaactgatgcgctgcgatgcattcagcgttttgagctcgtccaacagttgacgcatctgttcgggcggtatctgactctggctgacttgtcgcactccgtccaccacctgttgcattatgctctgtaaacgctcaaagttgaacatgctcaaaaacttgacaatttcctcgttctgagtgagcaagtttcggtagcgttcatcctgcaccttttcgctctccacaagggcctgcataaagttttcaatgttttgattgactacattttttaggcgtaccgacaatcgatccagcagaggttccatatagtctaccagatacgattccaggctagtttgtatggcagcctttatagcgtcaattttaggcatattgttactactgctactactaccactaccactactactcttcttgttaccctcttcaatcaaacgagtcaagtgatcctctagcgcattgatttgcttttcgtttgatttggccatcgagtctagtcgatcctggagtgcattattaaggtggtggtgttggcccacatcatcaccactacccttgaccggttcgtgtatagtctgcgacaagtcattgatggccaactccattagattgagtttgtcattgatcgtgttgagcaagtcgatgacgtgcacgtccggcttggtctcttcgggctcgagctttacaccgtccatgtagctggccacgttcaatttcgagtctgattctgggctacgtattcgattcagatagtcggcatctttacgatccaccatggctgcaaagttttcataatccatcatgccttcatatttgctagaatcgtactcttcaatctgttcgagtggtcttgcattcaaagttccattaggcacttctacaatactatagtttgatggattgttgtcattattagtattagtattagtatttagaggacctacattctctacaaatgtaggcatcggtagattgccaacatccctagcattaccactagctcccccttgcactccacgtacaaccacagacgtaaagtccatcggtacagtgtacaatgtctgtactcgatccagactctgcaacagtctatcggatgcggcaataaccttgttgtaaacatttacaaagttcaagtaggtctgtatcgagactcgtttgatgtttagggtgcgactgacgattcgtctcagagtagtaaaacttgacgtgtcatatttcatgcctgtggtgatcaatgtcaagtcgttgagttgatcgctaagggtacgcgacgcgtgtctgtattcgtcgttcaaaaaggaatgcaagtcgtacaagtctacagaatcgcgcagtagctttattcgaacagagtttattttaccctgagccttgtcgtacaacggctgcattgaattgtacatgcgcgtgattagatgaatcagttcggtcgttgcactcttaaagtttttaaatgtgtactcggtcattgttgcacagtcgcacaagctcagtttacactgtatcgatcagtggcgctagtagtctgccgtcgggtgtgtctttgagttttttagaatcagtgctcggacctttcttgtaatattcgcacaagggaattgtcactaatcgctctacaataaccacaaagagggcaacgaccagcaacaatagcagcattgtgcgtgtcaaatcatttgtgaccaatctcaaacaatcgagaagtcgccatttaatggcagcgcctagactacatgtaagagcatattggcgttatgcgtatatgtgcaaagttttaaaggatgataaacgctgtccgttttattcagactagtgtgtcagagcaactcgtgtattcatcatgaatcttggaatgctagtcagtttgatcgcgttgagcgtggtgtgcatttgtaccgtcatcttgatgtggttctcgttgcatacgttgaacgccaccaagattaagacaccacgcgaactcgcagactttataagcactcatatgaaaaagaatggcacctttaccgtagcgtttacgtatcgctacaacaaggataccaacaaatatgaaaactactatgtcgacagtttgggtaagctagtgcgcaaatacgaagacttgccgataaacaatctaggcaacccggtcgacaacggtagagtcaacaacaagcgcaaggctagagacgacgccagcggtgccaaaaagcgcaagggtctaatagagaacgtgtccgatgagggtttcacagtgaccaacattgaaggtatgttcaagtgtccggacaattggatctggcgagattcggaaaagatgtgcaaacccaaagctatatgtcaagtcgacgacccgatcggtacaatcaagggtctgccgaccaaggatgcctcatcgcccacactgtaccatccgcgcgtgtacgcagtgtgccagggacccaccacggaaccggtggtggtcgacgatgccgactatgaatttagggatcaactaacttccaacccaaaagtcaaaattaaaactggtcgttgtataaacaacaaagtctacaaccaaaaactcgtaaaccgtgccggtagcgatccgtgcgtattttatgacgtgtgtcaaaacaaagaggacggttatactcatgccgataaaattaacgattacacgcctagcgaatatgaatactactcttgtcacaattcaactagcgtactcaaatcgtgcaaagccggtctaatttatagcaagattcttaaaacttgtacttttaggaatttgtgtaacgacaaaccaaacacgtttacgctaaagattgacgatactcgtttcctaaaatgcataaactactcggaggccatagtgtcttgtcgcgacggtatctacacgcatcccgacggtcggatggagtgcgtgtcgttggcctgcaaagcactgtacgattccaatccggagcatcatttcagagcgttggagattcaagactaccggtacatgtcgtacgttagcgctatcgaaaagtgcatagacaacaagattcacaaaattaccaccggtaatcgatcaatcacctacgctctggaaacgcgctccggtgaatactatacggttacgcgcaaacgtctcaccgacgatccgatccgagtgcccggttcgattatagacaaaactggccaaatggtcaccgttggcactctggaggcactcagactgctggcggatcaattgattgtaaccaatcctataacgattcgctacaactatgcatcgccgtggttagagtacgatctcttcaagggtaggccgtttaatgccaaaaagtggaatcgcgtcgcagacgtggacaatccggttagcgtttcggtcagcgatacagacaaggctatcgtcttttcagaatactatgaaaacattgagaccaaacagcgggtaccgttcaagtcggccatgacattctacagtaccaatagaccgtactttttcaaggatcccgatgaggatctggtgcacaaggaactggcaccggacggtcacgtactgtgggcaatgtttagacgcaaacgcagtcagccattggacatgtacagcctgtccaatctgttgacgacaaagggcgccttttacgtgaccgaagagtttatcaatacgggcatcgttcgcatggtggagggtttgccgtttgacggtaaactcatcaagaacggtaccgtgatagagtttaaagtgtttatgaacgatcgctactacaacgttaccgtaccgatagccagcagtcaacagctgaaacagtttctagtcacaccgtcggtggtgcagccgggttcgtttaaaacgatcgagtacgacgagtccaagtttgactatgacacgtatcgatactttatagtgaccaacattatgtttactcaggaaacgtttgtggagcacgccttttcggccgagtctgtaccgtgcgtgtccttcttcatatcgctgttgcctctgtccataatgggttggttgggcgatgttaaagactttgactatcgaagcttctttacacaggacccaccgattggtggcagagagcgtcggcagaatatggatacggtggcaccacagattgtagaattggttctacctcccactttggaggaggtggacgagtcgattgacactgacgaggtcgtggacgatgctctgcgtaggcgcaaatctagaatcgtagactctagcgagattgctgaatttgacaaactgtacaagtacacgcgaatggtactcgattcgggcaaagaattgaaacggcccgatgaggattacgatgcgtttgtggcagcgttgcctagtagaattatggaaaagttagagagggaggggaaatagaggtatagtttgaaatagatgtatagtttaaaatggaggtatagtttgaaatagaatgtaaaaatataggtagtgtaaataaatgaaagtagcattactagttttagattgtagactatggttgtttatacacacaaataccaagagagagatcattaaaactgttgggtataggatttggtatacatgataggtttatagaaaaacaagagtacaaactaaaaccatacacaatactggcacactggtacaactacaggcacccgcacactttcaggcaagtggccgcatggtcatcaaatgggtggtttttgatgtagtgttttatagtgtgtgttgttgttgttttgttgaatgttgtcaattttagtaatgtagatttgtagatgcaggcttgtacacaattgtaaattatagtagatttgcatgtacctatagtttgtgtagtttgcttggagatttttgctttgagtattttacaattgtaaaggttttgattattttgatcaagtatttaaaatacacaaccattggtaaactacacaaactgaagcaaaaaacaggtagtgtggtgtaggcatagaggcatgcgcgtattgggttacctttgtttggtttgcatttccaagtatgcatatgtgtgtatatatttatataatgtgtaattataatgtgtaattataatgtgtaattataaatgtattcttcccattctattctattcaactctactctttatactaacaaacttgcatttgctttaaacttactaacattcacactactcgatctgatattgactaaactaatgaatatctcttgtatgtttatagatggtgacgactcgggaaaggacaaagctggggacacggacaaggctggggacacgggtaaatctgtagagggaaagaataaaactctagagattatgaatcaaactatagagaccaagaataaaactgtagagggaaagaataaaactgtagagggaaagaacaaaactgtagagggtgagagcaaatccaaacctgccgaggataaaaccaaaccggcagaggataaagacaaggggaaagacaaggggacagacaagggcaaaggcaagggtaaaacgactgaggacgaggttgaatctgacgaggatattgacacagacgttgacactgactctgatgaagacgaatatactgaccatgatgaacgaaacaattcagctaaagcatttttgggcgcgtttgctgaatatgatgaggaggcggccaaatcggctgaggagaagcgcaaaaaggcaaaagagttggaacttgctgatgtacccaaagtgaaggatggtgagggttctaaagcaaaggatgaagctaaagcaaaggatgaatccaaggcaaaggcaactcctaaatcaacagagaagcctaaagcaaaggatgaatctaaagcaaaggcaactcctaaatcaacagagaagcctaaagcaaaggacgctcctaaatcaacagagaagcctaaagcaaaggacgctcctaaatcaacagcggaacctaaagcaaaggcaactcctaaatcaacagatgaagctaaagcaaaggaaactcctaaaccaaaggatggttctattcccagctcacttgtaccagattttgaaagtgagccagattacgaatcggatgaagacgagtcttccgagcacgaaataacttctacaacactattgaatgcgttcaacaaattggacgaagagagtcgtaaggaggctgctggtagcactggtactggtagcactggtactggtagctctggctccggtactggctctagtactggtggtggtggcaaatttgccaaacctacacccgattctagcacaccaggtaaagacaaacgagaggttgttagaatagacacggttggtgatgctggctctaaatctggtactaaacatgctgttgttaaatctgggattggtagctctggtaaaggctccgatactggctcgggcacacctaaagttgcagtagccgactctagtgttgaggatgaaatgtcagagggcgaagaggagactgatgaatttgatgaaacgagtgcggctgaggcagaaaaggctcggaaggttttacttgaacttgaaaaaggttctgttgctggaggcaaagctaaatctagtgatgtaggtggtgctaaagtagatgacaaaggaaaggaatcaaagagtcttggtaaaacagaggacaagggtgttaaagtagatgacaagggttctaaagcagagggcaagggtactaaagcagaggacaagggtgttaaagttgacaataaagaggaacctaaagtagatgataaaatagatgacgaatcagacgactctggtatggacattgatgaatctgatgaaacatctgaagaagaggcagaaaggaatcgtaaattgttaatgtctacatttgaaagtttggacaaggaaaagcctgaaaaagtcaaagttgacgacaaggcaaagactgatgaaaaagcaaaggccgatgccgcagcaaaagctaaagctgaggagaaggctaaagccgatgccgctgcaaaagccaaagctgatgaaaaagcaaaggctgaggcgaaggctaaagccgatgctgctgcaaaagccaaagctgatgaaaaagcaaaggctgaggcgaaggctaaagccgatgctgctgcaaaagccaaagctgagaaggctaaagccgatgaaaaagcaaaggccgatgctgctgcaaaagcaaaagccaaagctgaggagaaggcaaaggctgatgcggagaaggctaaagccgatgccgctgcaaaagccaaagctgaggagaaggcaaaggctgacaaggctaaagaatcaaaagaactagagtcaaaggataaaactgaaacacatgaagatgtaccagatgagttggacgagtcgggttatcatgaagatgaagagccaaccggtgtcgattacgaaaagagcaagcgtgcattcctaggtgattttgatagtggtagcagtggtagtggtagtggtagtggtgttggtactggtgttggtactggcacaggtacgggtaagagtactggtggtgctaaggatgaggttgatgctaaagagaaaactgaatccaagccagaaaccaaaccagaatccaaaactgaatctaaagcagaatccaaacctgaatctaaagcagaatccaaaccagaatccaaaacagacagcctagatgaactaatgcccgagtccgtcgatgcatcgctagatatcgaagagatcgatgcctccagtcacacagttgatcgtagctttgtcgatgcactagacggtatggatcatgaaaaagccaagacggcgctaccgtcaatgagtaaggttgatgatggtaaagtaaagaaacgcaagcggtcaaaggagattgatgatgttgtagatgcaaagaagacaaaggaagctagtggtaaactaatagttgatggtacactaaaagatgatgttgaaccaaaaactgatgttgaaccaaaagatgaggttaaatcaaaagaggacccaaaggacaaagctgaaccaaaggacgctgctaaagaaaaggagggtactaaaccaggtactcgtgcttaactatatacatgatttgattagatttactttgatttgactatacgactcttgttgtactatgctcataatatgtaattgtatcatttaacaaaacttttgtattgcatcttgcaactcttgtactaaaaaatatcttgtaataaaaacttgtaataaaaaaatcttgtaataaaaacttgtaataaaaaaatcttacaataaaaacttgtaattacttgtaataatacttgtaaaaaaatcttgcaataaccaattcccaactaaatattgtaaactttatattgaattctgttctgatttttaatcatgtcaattttaaattacaggttctgcagacgagccggatggatactcgtacgacagtgaagaagatcttgagacgcacgtagtaataggtaacgttgacaaatcatctacttctgaaacagtagagccaaagggaacgttaggttttgtggatgtgaaagaatctacagaagagggtacaagaaaatctgcaagtttcgatagcacgcataaaacattattatcggtagaagacattacagagcttaaggctgcaatgcacggtaaaaaaggcgccaaagagaactttgatgattctagtgaaattgttagcaaaaaagcaatgaagatgggtatagggtttggcgttgatgatgatggttatgagaatatatcagactcggactctgagtctagtgtagaaacggttgctagtccgcccagtattgaaaaggaggttattgttgaaaaggaggttattgaaaaggatgttgttgaaaaggaggttatcgaaaaggttgttattgaaaaggaaaaggatggtattgaaaaggaggttgttgaagaaaaggatgttattgaaaaagaggttattgaaaaagaggttattgaaaaagaggttattgaaaaggaggttattgaagaaaaggatgttattgaaaagagtagtgtagcatcaagtgttgaaactggtggtactataccaagcactgaaaaggcaacaaatccacccaccattgaaaagacggttccagcaacggtgctagaccctacactagttatggaagtggatgaggatgacgatgactatttagaggcagaaccaatggatgtagatatcgagtccgagcctgaacccaagagtgaatcggttccaaaggatggttctgtagagacaatgaaggatagcactttagagccaaaagaggtaaaggttgtaagtccagttatagattcaaaggaaaagactgtagatgagaaatctgaaatgcatgtagattcaactgtaggtaaatctgtagtggtttcagagccaaaagtagtcgatgtcaaggtagatgctaagggtgatcctaaattagattccaaagttggtaaattggatgataaatcggaggcaaaaactgaacctaaaaccgatgctaaaattaatataaaaacaattgaccctaaagtagatggtagcgttgaaacaaaggcagagcccaaattagacaaagtggatgataaatctaaagatgaggttatgccagaaagtaggccagaacttaaaccagaaagcaagccagaaattataccagagagtaagttagaaactaagccagagagtaggccagaaattataccagagagcaagtcggaagctaaaccagagagtaggccagaaattataccagagagcaagtcggaagctaaaccagagagtaagccagaaattaaatcagagagcaagtcggaagctaaaccagaaagcaagacagaaactataccagagagtaggccagaaattataccagagagcaaggcagaaactaaaattgaccctaaagttgaatccaaagaatccaaacctaaagatgcccctaaagtagagctatccaaagctgaacccaaggtagttgaaaacctaaaactgatcctcctaaagatgatccagaaccaaaagtagaaattaaagttgtggagccgcctaaagctgaatctaaagtagtggtagaaactcctaaaactgtagaacttcctaaagttgaatctaaagtagtggaccctcctaaagctgaatctaaagtagtggtagaaactcctaaaactgtagagatgcccaaagttgaatcgaaagtagtggtagaaactcctaaaattgtagaaccacctaaagcggaatctaaaacagtggaccctcctaaagctgaatctaaaacagtggaccctcctaaagcggaatctaaaacagtggatcctcccaaagcggaatctaaagtagtggtagaaacacctaaaacggtagaaccacctaaagcggaatctaaaacagtggaccctcctaaagttgaagttaaagtagtggatcctcctaaagttgaagttaaagtagtggatcctcctaaaactatagaaccaaccaagactgtagaaatgcccacaattgtagaaacacccacaattgtagaaacacccaatccttcaactcctcctgatttcgatgaaccatctatggaatcgttcgacgaaccgatggatgttgacgaggacgaaatagctccggcattcaatccattcaatgtagttgacaaagagcgcgaagaggttaaacgcaaagaggacgaagccaaacgtaaaaaggccgagtctgaagttgagatgcacaaagatcatgaaatgcactctagtgagtttgaacctccatccattgacgagtccgaggagaccgagactgacgagtacaaggctagtgcggctgcatttaagaatatgttcagcagcatggatgccggtgaaatgccagaatcgattcaacgcaaagatccaaaaattgtagatgttcaaccaaagactcaaccaactttaccaaaggttatagatgtacctcccaagactgtcgaacaacccaaacgtaaaaaagagccaaaacgcaaagaggaacctcccaagactaccgaacaacccaaacgtaaaaaagagcaaaaacgcaaagaggaacctccggtaattccaaaaactatcgaacaacccaaacgtaaagaggacccaataaaagaaacaccaaaggtggacgatggtgaagccaaacgtaaagccgatgctgaagcagcaaagcgcaaggcagatgcggacgccgccaaacgtaaagccgatgctgaagcagcaaagcgaaaggctgatgctgaagcagccgaagccaaacgtaaagccgaggctgaagctgctgccaaacgcaaagcggaggctgaagcagccgaacgaaaaagaattgcagatgaaatagcagccgaagccaaacgtaaagccgatgcggacgccgctaaacgtaaagccgaggcagaagcagcaaaacgcaaggctgatgctgaagctgctgccaaacgtaaagccgaggctgaagcggcagccaaactcaaagccgatgcggaagcagccgccaaacgaaaagcggaggctgaagcagccgaagccaaacgaaaagcggaggctgaggcagccgccaaacgtaaagctgagattgaagcagccgccaaacgtaaagcggaggctgaagctgctgaacgaaaaagaattgcagatgaactagccgccgctaaacgtaaagctgaggctgaggcagccaaacgaaaagcggaggctgaagctgctgaacgaaaaagaattgcagatgaactagccgccgctaaacgtaaagccgaggctgaagcagccgctaaacgcaaagcggaggctgaggctgccgctaaacgcaaagcggaggctgaggctgccgctaaacgcaaagcggaggctgaggctgccgctaaacgtaaagccgaggctgaagctgccgctaaacgtaaagccgaggctgaagctgccgcgaaacgcaaagccgaggctgaagcagccgaacgaaaacgtatagaagatgaaaaacgtattgcagaggaaaaacgtattgcagaggaaaagcgtattagagatgaactagccgccgaagccaaacgtaaagccgacgaggaagcgaaacgtaaaatcgaatcaggtgaatttaaactccacagtcgaatctaataaacccataatggctctactttataaactgttttactaatcataaaccttttctcttgtttcagaacccagcgaagagtacaacggaatggcagactttatggccgacctagaagattaaataagcacatcataataataatgtaatgtaatgtaatgctaagcgcaaagtgtcgagtgtagataagaaagcaagtttatctaaaacgtattaaaagcaaagtgcaccgagtgtatcaaatgcaaaagttttactttgtaaatgtaaatgcctgtgcagttttaaactgtaccatagcgtacacacggtctaaaactgaacaagcataactttagacctaattaataattgcggataagaaacaatgtatgtgttttaattttataggttaatatgaaagaggttaagattttgattgtagaggttggttgcacattaggttaagtgtagtatattttacttgtaatatacttgatcgattttacttgtaataatatgcatacttgcttgtatgtttgtactctatacttgatgttgttagaaatatagaaactgatttcatttatcaattccattagttgataattaaacaaaatttcattagttgataattaaacaaaattccattagttgataattaaacaaaattccattagttgataatttaacaaatgagaatattttcatcacaactttacaccaaatgtattttataaaaaataaacacttgtaaaaaactacttgttttttagtcaaaaattacttgtttttttaatcaaaaaactacacctacatctacacctacatctacaactctatccaaaattctaaacatctctagtctttggtatatacaactgtttggtataggtatgcatatacaccatccacaacaccccacacaacaacaaaggaaacagtgttgtgcaattgtgtgcaacaatgtaacaaatgttcaactcttaataaaaaccgacacaaagtattattctgattattacctcctccttctggccattttcataacctttcatcacggccaagtatcaatattctcaggtttgagtataaagcaatagcctattggtgttatttcaccggtcagtattgtagtttatgaaacatttttcttgtattttttaacaatggacttttgttgtgtaggtttataggattgatattgtgggtaggtattataaatggtttacagtatcgtgtgtgtgatttgtgtgatgtaaccttactacactactaataataatacttttgtaatgtgtgcgcatgcacgtactttttgcacaatagagaataaaactttatagtagatgaaccagggtgtaataaaatggtcaagagtattgttttaatatgggtgcatcatagattatgacattaggtaaagtgccgagtgtagaggtgtcggtaggtagtggtagacatctagcaagtatacgtgtgcatatataggtaacatttagtagctctacatgccggcagcagctagccataaacctctagtccactttcaagaacttggactctaaaaccaaacattaaacacatggtttaatccacctttatgtgtgcatcaaggttgaattcaatttcaagcgagtgaattatttcacaccattcagtgaccagaaccgggcgagtacgggagttttgcagtgtgtgcaccaccctacatgtagtagtattatagtagttgtatgtatagcattacatacaaacttttgccactctgacttcagtctgacgcacactgtccactgtacatcattactggagatgtctagatacttgtacatttctagttttttagactggggttaaaaagtcaaacagtgtataatagagtacctactgtttttatagtatataccatgcttgttaatgaatctgtgcagtgaaaaacaagagtcgcccaatatacatggacttgactttgtataaatacgcgtgtgtatatagtagtgttgctactttgaaaccaaaacaaacaaaacaacctacgctgtagtacacagtcataggatagataaacggacaagtataaaatacccgcgcacaacacctacaccaaccatagtgcttttgctgttgaccagtgtggactgtctggactgcaatacctactaatagtactacctattgtattattgtggtttttaaataaattaaaataaaattgaataaataaaatttaaatactagacaacaaaaaatggaacccatggagtgcaagccaagtacctgcattgagagtggtgttggtggtggcggtggcgaagagtttacggcacctacgattactacaacggccgcgatcaatgctgttgactcggactctaacctaaacctaaatccaagcaacctaaatccaagcaacaacatcatcaatacaaccaaccctactactactacaacaacaactgcgacaactgctacaactatggccactaatgatactcctccaaccactgccaccgatgccgccaatgccactatacacaactcggcatcggcatcggcatcggcctctacatctgcttcatccatctctgcgtccgtctccacctcggcatcggtatctgcatccacaaacgattgcaactcggccgacgagctaatgagtacgttgcgtcaaaaactcgtcagactcaaggagcgcgtctttaagaattgcaaatcaaaactaccgacgtggaacaacaccgacgagactataaacatggtgcgatcgcaatcgtgcataaatcggtgcttctttaaactggccgaaatggatcaattgagcaactttagactgagcaacgatgccggtctgtttatggatctgtgcgctggaccaggtggttttaccgagtacctgacctacaagaattggtccaactttggcatcgtactacagcatcgagacttgccggtgcagattgaaaagctacccaatccggcagccgtcaaggtgtacactgtggacctgttgaacgctcacgatcgcgatcgctttcgacacgatatgggcatcgtcaaagtggacctggtggtggccgatggatcgatcgattgccgtggccgtgaaaatctacaagagccgctcaactatgacctgatccgagcccaagtggacgtggcgtttgatcacatcaaggtgggtggtaattttgtattgaaaacgtttgatgcattcaccaatcagatgctcaatctgtactatgagatttactcgcactttgaagagtttaccgttgtcaaaccgaacacgtccaggccggccaatgccgaacgctatatcgtagccatgaactacaagggtgcaatcaaaaagagtcaacatgcacccttttataataacaatcacaataatcaacatcagaaatttgagagttacaagagtttccattacgagctagtagccaagctggcacagagacaaattagcgcattgcatgatttactgaaacagacaaagaatacccccttgtttgagaatggctacatgtttatgaagaacgccaaatgtacaaagactctgtttagcgtcactcccaaacttgtagacagtctaaagtgcatcaatactgtggatccggatttgttaaagtgtacacgacgagtgttggccgattcaaagagtgactatatcggttttataaccacctcaaacgaaccgcacaaactgagagtcaaacttgccaaggacgatggaggtagacgacaccagtacgattacggtgcctcggcttttactggcactggtggtggtgctagttttgatgctggcattgacggtggtcgtcgtggtggtggtgcagtgtacaattgtgtgaggaatcaaaatcagttgagtttgaatcagagcctgtataagcaacaacaacaacatcacaatcaatatccatacagtaccaaaaacaatggtcattgtagtactggaggcaataataataacaacactgccaacaacaacagaggccaccgttatgccaatcgtcgcgctaaacagtttccgcacttttattactattttaacaaatctggagcaagagtgactgcggtacacgtgccaataaatcagttgaaaaatacacacaaggtccagtgtagagttgtacattcgatgcaagttttgagcgactatacagtatcgtttacacttccaccgggcgtggtcatgtttgctctgtttaacattgatcacaaaactaaacgtttatacaatgtaagactgttggacttgatgcaaacgtacaacgccaactatagcggtgactcgttgcaggtgcgcaaaaagattgttaaagagtttaaatacttatacagcatcggccagcaggatcctaacggaaactgcgatataaaccaacgggaaacagctggtgatgcaaattatcattacaacaccaattacaataatactactactaacaatgcccgagagtccaagtttgataccgatgtattattgaacggtagaggttcgtttaacatgtgcaccaagtacattaccgtgctcgatacacgaggcggtgatttggtcgaggacgatctagagtttggtagcgagataaaccagcaacaacaacagcagcaacagcaacaaccacaaccacaacatgcaccatctggttatataccggtacactcggacactgtcgaaaccgatcccaatggtggtggtggttgtaccagtagtctgccttctctagacattcatccgatgccgtctagtgcaaagttgcacagagccagcaacgtaatgtgtctcgacaagagtgaagagtttgtcgactgtgccctcatcgatgacaagcccattgtgcagtatgcgcaacgcaaagactcgctctttgaagcacccatgaacttggacacggacgataccattatggacactatggaggaagaggtcgtagagagcggcggtcccagtacgggcagtagttttacgagcaccggtaccgtggccaccaatgtaatctatcctagcagtgtgagcgcagcctctacggcaaaggtgaaccagtctcatttgatgtacgattggtgtgataatgatttttcattttagttgaagtttctacatttatactatagattaaactttattcaatgtaaacatttttagctattggtcttgtgctttaatgttgtctgtacaatatctataattgtacaatatttatgattgtacaatatctagctattttgctgtataattataaaatctttcatgattgtataacatctatgattgtataacatctagtgtatagttgactgtacaacatctagttgacatcaagtttgcattttagtcataggtttgatttagagggttactttagagggttaatttagaggtttaatttgcattaattagaatacctacctttgttttggattgtaatgcccaacttttgtgttgagatttattgtcctagttttgtattgtacttttagatgtttatttagatgtacggtgtcggtactattgtttagatgtattgtttagatgtagtgtttagatgtatcatttagatgtattgtttagatgtattgcacttgtaattataaggagagtaggagactaagtatggccacacaatgatctttaaatggtagcttagtttgtagtttaggttgtagactaggttggtagagtagatggtagagtaggatgttagagtaaaatataaaacatgtattagactgtaatactcatttaatcaaatatattataattacatgtattcctaatgtattctcaaaattgtatctttgaaaaataaagcacctaattgagtacattcttgttttttagtcactataaaactacctacctatgataaaagaccatatactaaaacacctacctaactacctacttacctaccaccctacctacctacctacctatctacctacctacacacactacacattgagattgtaagctcacctaattatagactctaaacaatagccaagtggtttcatttcaattttagttcacttcctcaataaacggtactacatcatagcagttcacagcaccacatttatacatggaaataaacttctactataggtagtaggtaggtacgcattggtagaaatacaaccacaagtataggaaccatacatgtgtacagacctaggcatttcctgtgatcttctccacattttacaccttcctctctatacccctcatttatatccatctatattaatttcaaatttattatcaaccagtaaccaatttagataatcctatttatatttgcatttatacactttaaccatttcccacatttatccatttcccatttataatcatatcctttggatgtttgttctacacacccgtgctcaggttcattatctgaaactcgtaaaatgagatcgtaaaaataaatacatagtgggtgcgattatttgcgcatgcttgttgtgcattttaaaattgaatgggatctgtactaggtgtagtgccatggagcgcgacagattagcaacagcagcagccagtgcacctagactctatatttgtgacacagagggattaatggttcgttaaaatcatacaatattatcaacgataaatactgcgctgctagtattaacggtgttcacagttatatatattggcagagttaatacctgatgtcgtatacgctgcttgtatactttaccgtgtggcggtcaagagttgtgcgtgtgcgactgattaaaaactcggtgcattattattctagtgtacagtgaataatagttaccatttatttgtacaattacaaactacaaactataaaatataaaatataaaatataaaatataaactataaactgtaaattataaattatcaactacttacaactaatactagacttatattttacacctacacaaattggtacacttgcaagatttacatacacagaaactatgaaacacaaaaacagcaagaaactcaaaaatgctacaaatcactctaaaacatatcaacacaaaaagtacaagaataaaagatgtggtaccaatcagagtgtcacggtcatggaagatgcggtcaatgccaccgctcaacacaaagggtacaatttgagaaaattgcaatccaatacaaaacaatcaaccattgtggacggtcagtcaagtgaacagtttgccaataataattgtacaaaacagcaccagcaacaagagcaagaattcgacaccaggcatcggcaacacagggtgcgcagaaaaaggcatgcaaaggagtctaccggttcaaagactagcagtgatattggtagtgacattggtagtgacattagtgatggtcctagtgtaatggatggtcctagtgtaatggtttcaaagtgtgtctcggattgtccagtaaagtgtggtaagattggtaatgattataatgctacgactgctactactagtattgatacaagtaacaacatcagtactagtagcaatatcaatactagtagcagtatcagtgctagtaccagcatcagtactagtactactgctaccactacttttactaataacaacacaatttgtaaaactacaagcacaaataatattagtggcagtggcaattctctactcagaacatcattactgtatcccaagagattgttcaaacaacctacacttgcaactaaatgtgctcctctagccaaacacacatcgttgccgttttgtctgcatctttacactccacctgctcatcctactagtacgcctaccactactcatactaccactactcatactactactcatactaccactactcatactactcatactactcagcatcatggcaatcctctaccttggacttgcaactattcaaattcaatatatcccaatcagtataatgtgaataatcaacagtatcagaatcagacgcaaactcatactcagactcagaatcaaactcagactcagaatcaacaaccgtgtgtcaattgttacaagggtatttgttgtaatttaccaatacctcatcctccaacttgtacttgtaatcaaacctacaatcaaaactataaccatcaaaactacaatcaaaactataataatcaaaactacaagcaagactacaatcaaaactacaaccatcaaacctacaaccatcaaaactatactccatcatcctacaaccatcatcaaaattaccatcaaaagaagtatcctccaaattatacacattctacaagtaaccatccaagcaatcgcacaaacaataccaacaaaccaacctactactataccctagaacactttgcacacttgtgtgaacgcgtagccgcaaccgatcaaatgtcggaaaagattgaaatcgtcaaggtggtctttgactattgcgacgacgtaaagctatggtgccgcatgctattgccccagctcgaccccagagtgtacaatctcaagactagacagttggtaaaaatgtacgctcgcgtcttcaacagtctagtcaacaacagtaacaacaatagtaatggaatcgatttgacacgcttttactgtaattgcaaaagtaacgatgtcggtgctaaattgaatagattggaaatgttaagagtggaattgctacaaacgttaatgtttaaagacttggagagaaccggcgacgtggctcagactataatcagtttctttaacgaacaccattacaagtttcacagagagtgtaataaaccacacaagtgcaattttcttttgcaagaaactaatgacaagaatgcatctaaaccttacaacaacaatgaaagcgttaacgctgaggccttttatagaccccttgtacgtaaagaagaagagagacaaagaatcacgatgcctcaggttgacgagtttttaagcaacatggctgacagttcaatcactggcaaacacgcactattgtacgagataaccagacgatgcaactctatggaactaaaatatctaattcgtataatgaagcgcgacttgaaaataaacgccggctcaaagtgcatactggaagcgttgtcgcccaccgcatacttgatgtttcaactgtccaaagatttcaaactagtactggacctacagtgcggagaggataatgcgtcgacctttttagaagatccattctacgagtctggcagtaaaacaaacacaaatagaatcaacagacccattcaggacgttacggatgtgttacatgccaacaagtttgagaacccgtacaagctatactacaacacaactacaacaactacttttagacagtgtacgtgtacaaatatagctctgtacaatactatacctaatgtaattaataatggtaataatggtacctttcaatattcaaacgatgcaataaattcccatgatgtgactttgcataatttgcaattgcatcaatccaataatactaacaataattctcaggacagtgtacaatttgaaaatgctagctgtgtgttgggtaatcatttaactggttcatcttttagtacagggggtactgcttttagtacaggtggtaatactatcagtacaggtggtgctacttttagtacaggaggcaccactttcaatacagaccctataaacaattctctagaaccttggtctttggtagagtgtccatcaaacaatgtactaggagatgtggtgaactccgagtctttgccttttaataatgtagaatcgttcaattgtatggagccgttacctttcaatagtatggaacctttgtctttcaatagtatggaatcgttacctctcaatagtgtggaatctttcaattgtatggaacctttaccgtttactaatgtagaacccaccaacagcatgaaccataacatcgaccagtacagtgctatagactcgctatcattattcaatacttttaataatttagactttcaagttaataacaatcaagcacttgatgtcgaccaagcttttgactctaaccttaatcaatcatacaacaatcaagtctttaatgtaaatccaaaccagacctttaatacacctcaaacatcttttaatacaaatcatacacctcaaccgtcctttaatataaatcaaccatttaatataaatccatcctttaatataaatcaatcattcaatacaaatcaaccatcctttaatataaatcaaacctatgccaacaacagtaacgaccaaccaacatctaataatattcaaactaccatatccgacaatgcacactcttcctataatgtcaactctaatttacaatcctataataccaaagagccatacatttatcataataataacaacaacaacaataactctcaatccaatgcatacaattccaataccagtgaattcaataacccggacaagtcactctttaacaacccatgcggtaacaacattactagtgctcccattgaaaacttgcaagtaccccagactattttagatttagatttccaagagtcgccgttcaacaccacctacaatacatgtaacacaacgtttaacaatctaaacttcaatagtataccatacaatacggtgccatttaatcccttgcactctgacgacaaggccaattttgtgcacgtgcaaccgcaaaggagaccacccaaactacaagccaagtctaaccacaaagggtgtcgtaaatcttgcaaatgtaaaatgtgcaaggactcggtggatactgcaagtgtggtagattctataggtattggtggttgcggtgttggtgttggtagtagtagcattagcggtaaagtacaagattgtagagtgatggattgtagtataaattgtaacatggagtgtagcgtagagtgtagttttgaatctagtgttgatggtgatttacaacatgatgtaaactctactaccaacacaccatccagttccaacactggcaccatcaacactatactcaatcacattagtgtagacactctgggtagtcggccagtaatctcactgagacccatagactctttacgatgcactacaccaaagggcagtacggtcaactgtgttgacaattttgtgcaacctacatctacagtcacatccatgtccaagagtcgacctaggttgaacacaaagttgagcagtattggtatggcgagtgctagtccaagtgttgtaaatactactggtatgaatagtacaagtgcaagtacaagtaaaagtacaagtacaagtacaagcaccaaaggctccggagtcaatacacagattgactttgaagaatccctctaccgcagtgtaattgtacaaactcaaaaactcgatacactgtccacaaataacactctaccaacgactctttataatcctataaattccaatactctatccttttccgagtactttaaaatgctagcaaagatgcacacaacagaggatgtaaaactcttggccagtaccaataccagtgccagtgctgtaaataccagtctagtttcaaatgcaacaagtttatgtataaccaaaagtacaaacacgagtacaaattcaagtataaatacaagtacaaattcaagtataaacaatagtacaagtatagacccatttcaacccgagacaaccaaacaaacctatatacgctattgttataaacctaaaaactctaataaagttgcacgtatacgagtaaatctatcttccaagttgaacctaaccatggacgaaccgatggccacagtggctccgatgttggctgcccagtgcaagtccatagaggtggcctttaaaaagtttcccaatggcatgatgtgcgagtacaagtacgacggtgaacgagtccagatacacaagagtcgctcagatttcaagtactattctcgctcactgaaatgcgtacccgaaaagaagctcggtgacctaacacaattgttgcaacgagccctaccctctgagtgcacctgcatcctagactgtgaactgctcatgatggacacggacactggcaaggttctaccgtttgacgccatcggtgtgcacaagcgtaaagcgttcaaaagcgccaaagtgtgcatcgtagtgtttgattgcatgtactttaacggacgctacctgtaccgagagcctctgtctgttcggcgagacattatcaaagacaacctaaccctgatcgagaatcgtatagttctctctgaacagaagcacatcacctcacccggtgaccttatggaagagtttaaacagtgcatgcgcttaaacatggagggcctgatgctcaagtgtgccaattcgtgctacatgcccggcaagcgtagatggctaaagatgaagcgcgactactttaagaatagcggagacactgccgacttgatcatcctaggcgcctggtacggcaccggtcgcctgggaggcctactctccgtctttctgatgggttgcttagacagcgattgcgtggaaccgacatgggtgggtttgacaaaggtgcacgccggcctcaacgatgtacaaatcaaacaactcaacgacattcttgaaccgttgatggtgcactcggccgcaatggatgtgccctggcgatttgtcaacgtcaaggattcacgcaaactgcccacgatgattgcactcgatcccaagcagatgccggtactagaggtgttgtgcacagagctgacggccagcctatcctttaggtttccgcgtgtcattagaatcagaagcgacaaggattggaccggagtaacgtctctgcgctacattaaagagttggcctctggtgccggtaggctagagtgttgtaatgatcaaaagtctgtcgagatggaggatgcggaagatgtgtaggaggatgagggtagaggttgtaggatgataaatgttgtaagagtgtagagtgtacatgtttgaagaattagtttaagtcaccaatacttttatattgtactttagaatcatccttacttctttacaatttacaattgtactatactttacactttacactttgttataattttatatttatagtttatattttttgtaataaaagtttataaaaatgtgcattacaagtgtttaaaaaactagaacaattaccagtgtaaaaagtaagactatgaatacaatctagaattaaatgcaacttaagtcgacacaaaagtaaatgcaaataacaagtattgttaaaccttaacattaacattaacccgtaaactttataaataaacgtgtgttgctaaatcagtctgtgtctcaatgtttcaactctaaaaccaatcctacctaaaccattaaacactcttattattagctactatgcaacactactgctacattgatgcagaatgcaacatgacattgtactctaaaactcaatcacctcttctgaaaccctcttcgttcaccgtgtctgcatagtagtcgagctcttcaatatcctcatcttcatcatcatcatcatccgtactcttgtctttgctcttgtcgttgtctttaccaacactatcctttactgtaccatcaaccgaatctatagttttggatttactccctgattctttagagggttctggctctttagttggctcggactctatagagggttctgatttagacaattctttagatggctctgatttagacaattccttagagggctctttagtggactcttccgtcttgctctctaaaacatccaaatcagcctttgagccagcctttgaaccaaccgtctttgtatcaaacagcctatcgtaccgatccatcaacagtcgcttgcacaaagtgtacaagtctctaaagctcaagttttcatccaaaacgttgccaacgttaaagattgatctgtagagtaccatcgagtttacagcatagccaaacacgatgagtgctaccaaaaaaactagagcgatgactagcaccgctcccagcgtgcacgacacaaattgagtaaacaccattttatcgttcaattcacaatactcgattagctgctttgcgataatacgctataggtcttatcgccgccaacaagtatagagacgcatgctttaattttttaaacaaaactaaccatgcaagagactgcggttgaaatgtgcatcaagcgtttgaaaaactcttcgttcatcattgcacactatttcatacgcatacccagtttggatttggagattcatccgggcatgtatcaaaagggcaactttttgaatttaaactctaccaagcactatcgagtgttgacggtcacgtatgcgtgcagcgattgtctcaacgagctcctgatcaagagcgaaaacgtactgcacgcctggtactatccgttgatcaattgcgagactctgaccaagggattgtgcatcggtgcaccttggagcatccaaaccatactgtctacgtgtgcagctaccgtgatgggcatcctatttaccaagtatgaagcgtttacggccactctgctgactctgtgcgtgctagtcatcatgattctgtgcatgcagtacaacgtccggcaagatgaagtctacaagtgcatacacgtttaaatcgtactattgtgcactacaataacctatatcggttgtgattgtaaatggtaatgattccttgacgcttctatgcatttgcattcaaaagtttaaaaatgagagtttctttatacttttacgattcccatcatcgaccaactcggccggatgcaccgtccaccgatgtgtacaccaaggtgctgtgtcacgatccatcctcgaatctgggcactgtcggtgtacgtgtgggcaagaacgagctcgtactcggtgcgatagtgttcaagagcatcgccaacatggtgcccgacgtcaacatgtcctatctaatgtcggtgataatgtccacgctgcagggctgcggagaatctttgcaagacgtccagctgtacatttatccgccgactctgtttgagcaccatctcaactatacaaaccccaagaatcgattcatgtactataaaaactttgtaccgcaaacgttgggtgatcacgttagagtttcactaaaagtgtagattttagcataggcagtttctttagattaggacattatatttttttagatacaagcactgcaaacatggacgttgacgatgagcacaacttgatcgagactcgagtacgaaactgtcgcggcgatgacgacggtacttggacgatggaatcgttcatgaaccacatttccgaacccatcgtgtacaatgcggtaacgcagttggatcccaagcagtccaacaatgtaaacgttgcctacattcgcagtagaaacattttactatcgatgaagcacgctctattgcagtacattgatttgttgaacaacacgtttgccatgatagacaccgcctcggtccagcccagagtgttgatcgagaaacgcaccaactatatgaaactcagacaattggccactcgtatgatgagtcgcatcaatttgcgtttgcgtaggctcaccgaacgctacaatgaaatcgaggagcaaacgcaaacgtttcagcgcaaggccaactctctcaagtcgtctttcaacaacgacaacacttctgtggaccgagtacgtagactctttctcaccaccattgacagtaagaacaagattaaaccaatggtcgatgagtttaacgtggttgttgcagaggtgctcatggactatgacaattccaattcggaacagttggtggtcgagtctatggtgctgcctctcaagatcaatcctagctttatgaacgatttacagaatcgtttgaatgtcatcaacaagattgtccgagactatcagacgattcagttgaacaaatcaatcaagggcatgaacaagcctgtggagcagttgaatgtgctcattgataccttggataaagatgtaaaacgcaatgggggaggaaacggtggtgcaagtggaggtttcggtggaggcggtttcggtggatcaggcggcggtggaagcggaggattcggaggatcaggcggcggtggaagcggaggcttcggaggcggtttcggaggctcaggaggcggtggcttcggtggcggcaatggaggagacaccggatcaggaggctcgggaggtgtagatcccaatgttgtagtagattttggaaataatgtcaatctaaatggtaatgtagcgtttaatgcaaatgcaaatggtaatgtagaacctagcggtagtgtaggtggtgtaggtataggagtaggttcgggaaatctcaaaacatttatgccaactctgcagacgcagactgacgatgtcgatagattcctaatgaatcagagtgtacaatcaaacctacaagcaccaatcgtaccgatggatgtaaactttaacaatgcaaatgtcaacactgtaaatccagatgctttcaattctaatgtttttgatcaaaccaatgtcgaaatggttgaagctctaaacagacgcatggtgcaagatgcagacatacagactcagatcaggatgcaaaaccagagcatcgactttgggaggccagagccagagccagagccagcacccaagcctacacccaaacgtgtacgaaaacctagaaagagtcaaagcaaggtggtgcaaccgatcaaagtgatgcccggcacaccgatccaacaaatggtgcagtttgccgacactacaatcacaccgatacgcaatacagacgttgacatgcgtccgagtagatcgtctacaccaaacgaatcgttaataaagagcgagtccgaacttgatacgagcataaatattgtaatggaaccagagccaatgattgaagccgagcctcaacaaaagacccctgtaccaatgagactaccggtcagtattcctttgcccgccgagagattggtcgcgtttagtaaaaacattaacaacaatggaaatgtagatttgtttaagaatgctaacaataacaacaacaataatactagcaccaatacatccattgttagcaacgatacatccattgtcaagcaaactgtaagcaccgacttgtacgaaccgtcaaacgttaaagcaatcatgcagagtagtacaccggtggtgaaaaccaagggcgtcaccaaagccaaaaccagagccatgaagagtgtcaagcagcaggtgaaggctgtcaaacaaaagggtgccaccaaacagatgcacaccgtacaagaggagaccactcagcaaactgtacagactgacgacgatcaaatcatgcaagaaacggtccaacagacggtgcagcaaattaaaactgaaaccaaaacaccaacgaaacgacgaaggataacggccatgaaatcaccccgacagaaacgctacctgacgccagagtttgtcgagtcgagtgatgacagtgacgatgaggattcttccaagcccagtaccagcaacactactagtggtagtaatgctgccattacgcctcctaatacggttacaacacctaccacgagtgcaccacctatcaagagcacaactactgccaagagtgaaacgccggttaagagtacaccaccacctactaagagtacaactcctgttaagagtacaactccaaataagcgtacaccaccacctaataagagtacaactcctgctaagattacaacacctaccaagagtgcaactcctgttaagagtacaactccaaataagagcacaactcctgttaagagtacacctcctaccaatacggttgttgaaactgatgccaataaggttactgacaacagcagcgccagcaacactagcagtgccagtgacactagcatgtctccaccaaagacgcccattgtgcacaaggccaaacgacaaaagcgcaaactcaacgatccctcaccggacgaggcgacaccaccaaagaaggcaccgcctctgttgccgcgcatcatacgaggtgtgacactgaatgcgcgcaacaactttatcgtcaatctgtacaacaacaactaccaactgtttgatcccagcggtgatggcttcgaccctgttcaactgaacaaattcaaacagattagatccatgttcaagcaaatgtttaagaagcagggtagatacaccaactacctgctcaacaccaagattaaggataacatacaggcggtggtgaatcgattcctgggtgctgtgcaagccacgataaaggagcctgctttagatagcataatagccacgctcaaagagtacgagtctatactgaatgatgacattaacgagtcgtacgaagatgaccgtcgagcgtatcgaaataatgaacgcattgctgcactcttgcaacagtaccgcgagagcgatgaattcatcaaagccggcataataacgctaatcagtcaatcggagggtttcgaaggccccgacgtggacgatatgctcaacaagtctagaagtgatacatcagaatcctttgccaaagtgtacgccaaagattatgccacactagatagactgtccaagggtacactggccaagttcccaaagcctagcgtggagccacccaaggatatgagcgtttcaacactggttccgatacactttatttaagagagagcgggtaattgttttaaagtgaagagtagttaatgtttgtataagtactttaatgtttgtgtactttaatgttcaagtgtactttaaagtttcaaatgtactttaatgtctaagcgtgctttaaagtttcaaatgtactttaatgtctaagtgtactttaatgtttgtactttgtttgtactttaatgttgtagagagatgttatataaatattttaatattaaaagtgttggctacatctacatatatattttgtataccagtattgccagtgttcatctagttttagagtctaattttagagtataattttagattatagttttagagtatagttgtagagttttaaaatctagaatttagtctatagagtcaccatcacatggtatgaaatcttgagagtatttatagtagttgtacgagtatctaaaagatgaattgtacgagtatctaaaaggagtatctaaaagatgaattgtaagagcatctaaaagatgccttttatgcacaattggtaagaattactacaaggataatgtttgtaatacaacttatttttttattaaaaaatataaataattaaatataaatatatttatactacaataccaagtattattcattattattcattattattcaaagtaaattaaagtaaaataataccacatttttttatcctctacaatattacatccttggtatataaatctcaacaaaggtgcacaaccgttaatacacaacactcggtcatcggtacattgcccgcaaacacaacagcaaactcaactctccaaaatcaactcgttcaaatactcaaacattttgaccgattcaggtttggacagtgtgtacagtgaagtgtgatctccgggcatcactcgcaacgatgcaccattgttgtgcgcaaacgcctcactagagtctcggatgaaatcgtcagtgtttgtgagtacgtgtatacgatccgtgtagctcgctatggacaagggcaccggtgtcggtagatccttttcaacataaccaaccgacaagagtttgaacattagaaacttggttgtgctactaccgtagaatccattgatgccaatgaatcgactaatgtacatgttgctactatcatgtttagtgctgccgttgatgagtctaatcatgaggatggcgtaaaaggcacctgccgagtgtgccactataaagtactctttgggtggatcctttgcgtagagtgttggaatgtagttgacaatcaagtctctaatgtactcgacaatgtctcgagtttcggcatcgaatcgcacagggtgcgtaaacgttaccagtctgcgtcggtgggtaaactcttggagggctctcagctcgggcgacatcattacaaacatgccaccgttcagatagatgattaccggtgagcccggttcgtagccagtgtcgttgtacgtgtacactttagagtctcggtactcgtgctcgacatactcggcgtctgatgcatcgctgtacaattgcgacggatagttgcgtatgataatgttggccaccaactgaggcttccacactagtaccgcaacgcacatgcacagtgttgtataaattataaaacttataacactgaaaatgctaatcatattgttgcaggattcaccgagtcccattaaagtatacaggtatcgattcagcaccaatacgctataccgacaaaatctacaaaactaacaatgtcgtttctcttgaatatggaacgtaaacggctcaaggagctcgtatccagagactacaacatgctactggataattcgactcattacaaaaatgtctacattcacactataggaatgagcctgagcgacaagcactatgagcagatactgtgcaatgattttccacgatccccgctcaagcactttacaatgtttacgagttccgagtacagcggtgcggtaccgttggtcattagcaaactggacggagtgtccgagacgtacaacgatgcccgaccctatctgtctgtgttttacacctttgcacccaaccagagcgagtgctatagtttgaacattgagagcaaatacgatccactgtgcaacgacatgaagctgtggtactaccgagactttggaagccgactgattctgtttagagaaaacgtgcacgactacaaggagctcatcgctaccggcacatggaaactggccaacggcggtcacagttcaatgatgagcggatgcggtggtggtggcaatagcagtataagcaacaacaatggacactattacttgggatctagtcaggtaccaaaaaaggcaaaggatgataggaccgagtctcaaacagaggctcctctgtctgagcctcggatagatttacaaacagacgttatggatgtagagaatcaacaacaggacaatgttcaaatagagacagaggtggagtcagactccaagtctaggtgtccgtttaatgcgatgccacacttgaacgatgtagtcaacgagtttaattacgattgtcaaaagtttataattttcatgagcatctcaaactgcaaagaagtgtatgatttcaagcacttgaaaaactttgccatcgactttggaggcaagattgtcattgatcaaaactatatcgaaacgtttgtaaatgctcctaggattacgtgaagtgtatacctacctagtgtgtttgattatatgttttaatttacaagtttatttttttgaataaagattcaagagtctaaaaaactaaaagttttattatttcttaaacatttaaatactttatttcttaaacatttaaatacaagcacatactctacctacctacactaaacataacattttctcactctacatgagcctcctcttcaacatgaaatgagtacacactggatgcctagcgcatcgagtctgtttggtctgaagcatgcgttgacacactttacagtttttacactttatacaattgatgaccgagtcggaggaagagtccacttttgatttaccgagtccacttgaaatcttgccaggctttagttttttgctaccgtgcaacagcatcgccaccgaacgattgtactgattcaccgagtccaacacgtcctcggtacagtacctcgaacgagtcttgatggatttcttcaaatcgttgagtgggccagtttcgaaatcgatgcactccaacgatacggtgcacattttgaattgttcacactccgagtctagacagcaaaacgatggctcgccaggtcccttgagcgagtacatgcgattcccgcactcggagcactttacgttttcgtatgcggtcaaccagatgcgcggacgatgcatcgattgcagcacaaatggtggagcatcgggatacaccttgggcgattcaatctcattgatgggcaagtaccgagtgcgcaaccatgaactcatcgagtttggtacgagttcaacgactccaaaaatgatacgaatcgagtctttgatgtcggaccagactccttgctcgtcctcgtgagtcctatagattgcataggcaaacgctacaatttcacgattgtgaatcatgtcgatgagcgagtcctcggtgacggtcaactctccaaacttgtacgagtctatactgtaccatttagtcttgttggtaaagagccacattgttagactctttggtagaatgagttttaaaatgtcaatattcacgagcggtggctccgagtctttgttttcattgttttgctcagccttgaactcggactctgctaaacacgtttcgattccattggtgtcgacaacgatattatcgttggccttggttgccgagttcaagtctacaagagaatccacctcttcgcacacgagtttgggatcgtagactcggtcaacctgtacgagtatatcgtaatcgttcatcgaaatgaccttcatcttgaaaaatctctaaaaaaacacaagcatcaatagaccgagttcccagacgtaacataaacctttcggtccttgggaatcgtacgcttgcatctcacggatcgttgagttaaacacgaaatcataataacaataacagtcatgattccaacgattcccacaaagtagctatgcagcgcaactccgtacggaccgatcgtcttgtttataaactctaaatacagcgaatcgtgatccattccgagtgtgcatttatatataatttcaataagcaataaccccaataccgtattgatattaaaggcatgagttcttacatagaaatgagggattcggaagctttggatttgtgacaattctggctacgtgctcataggcacgtacatcctgaattgaccttggtagttttccattttgataagatttgattttcaaaattcctttgtctgaaacagtatataaagagacaaattttctggtcagttcagtctactttacacacccggaccaggaacaagcagccaaaggaccagcccagagcctcagagggagccccaggagtcacagatgagtactcttttgaatcacttgttgttttgatttgtatttgatggactctttgattgtgtttgactcgttacatttgtggggactcggagtactcgttaactcggtgtgaatctgtaactcggtgggggatcgttacatttgtggggaatctttaactcggggactcgttacatttgtggagactcggtaactcggtatgaatcgttgactcggtggggaatctctttgactcagtggggctcgttaactcggtgtgaatcgtaacttgatggggactcttttagttggactctttgggtaaactcggtgggaatcgttgtttaaataaatgtagactcggtggactcggtggactcgttgggactcgcgaactctatgtaaactcggtggggactcttttgatagaatcgatggactcgtgtaatcgtaaactcgatggactcgtgtaatcgtaaactcgatggactcgtgtaattgtaaactcggtggactcgtgtaattgtaaactcggtggactcgtgtactcttaaactaatatggaatcgtttagtgtgactcggtggggctcgtgtactcttaaactatatggaattgtttagtgggactcgtgtactcttaaactatatggaatcgtttagtgtgactcggtgggactcgtgtactcttaaacattaaaaatattaaacttgtaatcttaaactcttaactcttttggtatagagactcgggactcgttgtttccaaatcaaactaaaccaaacttgaactcgttcgtttaaacttaaaccgagactcggtcaaggattcgggctttgatttaaattgtttaaactggatcatttagactcggtgtggctcggtataactaaatgggctctttgattcaaacttgaactcgggagttgaacttgaacctgcattgtaagctcggcggcgtgactaatctttataaaactctgtgtaatacgagtccaatattttgctttgcgctctacctactcttgtaacagttgacttctattgtgtatactatataatgctgcatattaaaactatatattaaactagctactatttaataatttgcataatatttaacaagttacactactatttaataatttacacattcctactacttactaacaagagttgtacataccatttaaaattattgaaaggttactggggcacttaaaggttgctgggatattttaaaggcatcatccacaagactataactcaactttaacaactgtaaaatctttaaccgtagaatccaattgtttgatttaaggggtactgaaaagttgagactggtttaaaccggtataaattagacttgatttaaatttggctagctagtcttgatttaaatggggtcttgaatgaatgctcgtaaagttggactgattggactatgctaattggacacttgcatatagagacatagaggggttgcataaattttgtaatgatgcaaatctataggttgaagcgcattctgtgcaatgtctcaatctacaagagttgatgtgccggtaacgatacaatgcgatgagtgagtaggtagttgatcgacatcacttcttgcatgtagtacgacccttgtagtaaccaagtattgtatctatttggcttcttttctatacacttgcttctctatgctttgcacactgtactaaataaaatgtgcgtgtatctattgcttaaactaacatttgacttggacatttggaatacctacctaaatttagagtacagcgttgacattcaagtgaagtgtgaaatatacaagtggacagtgcgtgtgtgtgattattattattgagtgtaaagtgtttatatattaaagacaatttcgattcagtgtttgcatattcgagtcagtgtactttgatgtaaacttttgatttaaactttggaattttaatatattctaaaatctaaaataattctaaacagtgaaacagtgcagtgaagtgtgaaatacaagtgaagtgtgaaatatacagtgaagtgtgaaataacaagtgacaagtgtgaacaagtgttttgaatgaatgtacagtttgtcaagtatactgaagcgtcagagtaaatgataaatgattaaatgtcaaataaatgcatcttaaatgcatctcttaggttgcactctgtaaccagggcggctcttgcaagttggcataagatcacaaatctctgccaccttcaatagtttgatcaaaggccggggctaggtactcggttgatggcattgtatggaagaatgtttgaacctaaaggattggctagtttaaagaatagcatactagatgtgaatataatttatagtataaaagaaggatatacttaaaaagaatagcaccacctgatgtgcataaatttagagtagcgttaatcaggtttgtgaaatttatgcatttgtcaagtttactggaagagcgctctataatttagaattatagttttatagaggctataaaatggtatgtgaaaattaaaaagcctgtgaaaaattaaatgcataaactgggagtgtgtatattaataacaaaagttatactgccataaactggaccacctagtaatgtaatgcacggaagtgggcatctattatacaactttacaagccaagagattctaaattggcacttgaagtatttgatagctttccagagttgaacaaggctgacggtaaagatgcctagattaaaccagcttgggcgtttaaaaataatttgctactaaaagtttaaactggcattaaattaaccaggcagtaaagtgggatacttggagtaaactgatggtaaaaccaactgacggtaaaactaaattgacattaaacagacactaatggtcttggctcttttagcggtagcatttatacatgcacatttcgtgtagtaagtatctagagtaatgtatgcatttacagacacatattgcttgttgacgggtaagttgctataataggataaattgctataataataacaccaagcctgctatcaaagaacattcatcataaacataaacatttaaccatgattaacaaccaaccatcaacatggccaatatttacatcattaaccaacatttacatcattaagcgtgtccatctaataagccataacttggcaagtaaatgattgaaacattaattggcagttatacactaaacctcattctaaagctcaatctaaaacctcatttagcttgattgataaacattattcctagccgctttatagaccatcattaaacctcatttactgattataatcgcaaaccattaacattaacaatgttggctcttggaatctctttatatgcatagattgaatcgctttataaatacgtgcagcagtgctttggttgggaatctttctgtacacttaatttgtgtgcttacagaaccatctagcggcatcggtcaaaacttgcacagagactggtgtattggtgcggtgaaggatgttttgagccgaggacaccttggatggtttactctgaggatgcttggattttggattttggattttggatttggtaaagtatgggaggatgtatggtaagatggtaagatggtaagacggtaagatggtttgttgtaaaaacatttaaaattatacaaaatataatttacaaaattacacaaggtgtgtatcgtttgattgtgttgaaatatactgatgggtagaatgtactaagagtgcaattaaatgtgtttcaggagactgagcagacaactgcacctatatactctaccttaacctgacgagggttggtaagtaatggcaagtgttggattggtaagtaatggtaagtgttggtaactgttggttttggtaagtattggtaagtattggtaaatggtggtttggtaagtattgtacagtggcaacttggtaagtatcatgtggtggtaagtatcatgtattggtaagtattggtatctatcaggtatgcatacttgtagtaaaactgttttaaataatgtgtctatatgtctataaccatgtgtaccactaatcaatgcattctctttcaggtttaatcaaacttatatgtttcagattcgagaactaataacaagtctctttgtttcagatgcactaatcaaaagtctctttgtttcagaatccttcatttgtaaagtattcaaatgaatttatacatgtattctgttgcaaactataagaattgtgttttaaactgtaagaagtctgttttaaactgtaagaattgtaacacaaacaaaagtataaaacagcctactgaaaaaccaaagcactcaaccatccaagtgtaatgctattgtactgtttcaggagcagaggacaaccctcttgcaaggtacagcatgctcaatttgcagctacaaggagcactctgtgagtatacaacctagacttgtaatataacagctaatgtaatttggtttcaatattgcaggtgctgtaattgacgcaaagtgatgtaaattgagcacggatattggacagctaccatacttggtgatttggtacgtatagaggtttagaggacttttaggttcaataaagagtttactacaacgccaacaacaacaacaagtgttttactgtttcccatcctattgtcccgtgttgtttaaatttgattaaaccttttataggttctcggaagtcatcttgtcagaagtgggattctacatgattggattctaaaggattaaactctacaaggagttgaacgtgcctacaatgcagtacaagcaatcacttgaaatgtgcatcatgcgctgtggaagtttaccaaagaattgaaaaataggaaatgaagaaaaaacaccccttcatctaggccattcgagataagaatacctgatatcgcacacctgaataaacaatccactgtgtggcataaacaaggctattgttttcgttttaatggccatattctaggaagcatattggttaccaagtgctgttgtcgagtgtctagaaacgtgatatgcgctgttgccatggaaattgatgctgtggtggtgctactttggattggaatgtctaggcacaagcattgttcaagataacgattggtgtttgctgcaactacttaatgtatagttttaagtattgttaaatgatgaaatgttgaaactatgtttgagagtgattggcatgtttgagacggacgagtatatttgagaatgattggtatgactaaagatgattggtatgactaaagaagattggtatgactgatgattggtatgactaaagatgattggtatgaattttacggcgcctagctataagttgactgcaacgtttagatgtaagatgatttgcggcttctagttttaaggatgcgttttagattttaaggattgaatagttttaaggatgcgtctagtctgtaagagtacggtctagttttaagtacacgcgttagttttaagaatacggcctagttttaagcacacgtattagcttttaagaatgaatacacattctagttttatttctagttgtaagtctacacaccaaatcaagagtcctttgattctagatttgagattgaactgtattggttcaatataagcacagtacattacactacactttacaaatcatcacaatcattacacaattcattgtacacaaattcatacatgcatttacacaaaacatgcattacacaagacattcattacacacaacattcattatacaaaatcatacattcatcacacaaaacattcattacacaaaacatcagtgtgtttggtttgtgcacactcttttttttgactactatctttgaatactacttactactaacctctactactaaccccaagtgtctaaccatttaaatgttgcagagtcacagtaaatgtctacacagaggtctacacagaggttcacacagaggtctacatagaggctgcattctacagtctacctatggcatccaatattccaatggttgctgcattcacacaacatctggattggtttggtatagtatgcaactggtttgtagtacatccatctctctagtatggtttgtataaatggacaatctagcttgtaagaataatgctaatgctagaatacaagggtacccaaatcataatgcaaaaaacatgtcttaatgttaaatgtttcagatgtgatgcagcgaaactccaaagctaacccttgtgtgtttcagatgcagtcgttctccatcaaaccatcaaaccatcaaaccatcaacaacaacaagtgcacctatataaagtgcacggcaaacttgtgcaatcgtacaggttgccgttacaggtatttgcatgcttttgaattttacatttaacaatgcttttgggttcctaaacctgtttaaacttgatgtgtttgttaaagttggaatgtgtgtacgtataaaccggtatgtggaaccagtttgggttcggaatgtggagcccgtctagcgtgttctgatgttaccaatttgagatgaatgttaccattttgagatgaatacaagggacgaatgtataaatgtataatgttggaattaattagaacttagactaagaatacttagactaagaatgtctattgaacatctgcagaatgtcttgaacatctattgtagtacatctactgtagcaatacatgtccgtatttgtatgtctatatttgtatctatctgtaattgtatctgtctgtaatttagtccaagtagaataagaaactctgaataggtacactctggattcaagaaagaagaacggtctcaatcggtatcggttacaaacgttgtttccatctataacggatctcggttataaacgttgattctatattctatctataaaggaactcggcatatgctactatgggactcgtatgggcatctaatgggtagactgaatgggtagcctgaatgggcagactgagacgcatcatttgactgactaaatccaacaacactcgactctttgacttgactcgacggtaccagactgtggtgccagactttcagacatcatatttccatactatttactcattcaaatcatctttatacatccacattcaaatcattctattcatcctctctctcaacatcaacatcaccctcgtagacctaagttttcatcacgtctacttttaaaataaaacacggactctacttgtaattaaatattaaataagctctatatacatatcgtctacatttgaggttataaaacgttgtatgcaaaattgaaaattgacactgttacccctcgcgcagagtcccggctatgcgcaagagtgtagtttaaagtgtctggctacattttagcatcagtcaaatgtcttgatttgcagctgaattggtataacctcgattgtaaacaatgaactgggtgtggcacgtcgccatcttgttgtgttaatttattatgcatgttaatttaagcgtttatttatagctttatacgttgaagatacattcaaaattcattcacacggttagaataacggtattggaatctagaaactagacctttaggtcgcaacagaccctcgggaccggtataattgtaggcgtttaattattgttataaaagggtagtatttaatgttgtagcgagccgtccaatgactggctatagactagacaacgccagagacgggacagatgccttggatgcatcaaaagtgtaaaatttaaagagctagcggtaaaaatgataaaagtatacaaatgtacacttttaggacaaaccagagtacagagacaccacatgtgaggtatcccacagatggtcttgtgaaaaggagtccaaaaatgtaaaaaagaataatcatgtagaagaatcattaagaggaatcgttccccccgcagaagaatctagtaggtgtgcacgtttttctgataaagttttattactcatcgaccaatggcgtcgctcggttcttatcgcaacagagtggggccatccgcactataaaaagccgagactggtgacgaacaccatcagtctgattcgagtcgtgttcataccgcactggtgtaggcagcgtctggtactaggtgagtggctcattcttatttaattcatttaatttgtctgctctgtttattcaattttaaaatgtgcagtctcgggtcatctgatacactttttatagctcttagcatacttaaattttatggagcggagtaatcgacccgaatcggacctcggtctggtacgaaacgatagcactgctctttgccaaaaccaaacacaactcgcatctgatccgctctgtgttcgagacatgtcgtccgaatgtgttccttaaaggcgacatgcgaccttgttggtcacaagccactgctcctatgcaaacgggttcctttggttcgattgtgtcgcacgagtggatgctaaattcgcgtgcaggtgtcgagacttagactttttagggagtaggtagcatagatgactcgggctgtcgcttaacgttgaatacgcagggtggactctttgaatggattttattcagatgccacctcgactcgaatcatactggtacccgttttggcactgtagtatcggcaacggtaatgcagtgtcgagacttaaactcttggtggcacagtgtataaactgtaggttctctctctcgtttatgaataatgttattattctacattagtcttatctggcccggcatgtactaggtaggatgtttttattatatacacacatgtgcatttgaggataataacaatggtaatgtgtgcgtgtcgggcatctataaatacacgtgtgcgtgtgtgctgttttattattattaggtaggcgtagcttgcacatgtgccaccatagggacttttagttttgttagtgtagtgtttttgagtgcaagatgtttgtttttactgtgcatttacaagagacttgatggaacacttatatgtagaacagtactactactagaggatagcatttagtagaggtgctgggaacaatagtgtgccgagtataatcataggtatgtgttgcaatacttttttctttatgcttttacattttacgattcattacttgacactgattgatattttatacttgttgatattgtgtggataatttatgaccatctgtgggaatctaggtaggtagggttttatacatgcttacacatacacactgacactgacacacattttacaaacaaacaaaacaaaacaaaagtacattaaaacaaacggaaaaccaataccatacattctatcattctatccttctactactattactactaccactatctactatgggtacctaccaaacattttttaaaaacatttttaaatctatacatacacacatggatttgtgctcacaacaacaaaacacaatcggttagggtcgttgggtctgttgcagtctcggcagcttaggtcggttagttttaggctcggttagtctgtaagcggtacggctagtttataaggttcggttagatataaggttcggttagatataaggctcggttagctataagtcggtgcggctagtttatataagtccggttagatttaagtacggctagtgtataagtcggtgtgagcacaaatcaatagatgtagtaagatgtgatgctttatgaattgaattttatgaattgatacacggacggtaaacaagagttgatttgtgtagtatacgtcttcttcttcctacttcctactattgtaaacaatataaaactaccaaatataaaaccaaacatttgtataaaataacaacacgggttgtacacatttacacatacacactatacacaccaatttagggttatgataatttaggacatttaggataatgacaaagtgtctctggtaaagactggtggtaagactggcaaatactggtatataaatgcaaggatacaactactgtaggtaggtactctgcaactattatactctggtatactcggcaaactttgtgtactctagtactctgataaagctatactctggtaaatattctggtagaactctgtactctgatatactctggtagacttttgtacatatacaactacaacaacaaatctggtaactcggtgactctgactctggcgtctcttggtaactctggtggtattggtattggttgataaaggtatcaacggtttcaaacaaaggtattggtatcaaataacggcatcaaaggtattacacaaaggtattaaacaaaggtattaaacaaaaggtacaaacaataggtttaggcaaatgcacacacataagttaagcacacgtagtaaatgcacagtacgtagggtgtctagtgcagaatttgatactatgagcgtttcggttcggtaccgtttaagagggcgtagagtcaaacctttggcatggtttgtatcgcatgcaacaccaaagctagtggtgcatgttatgctctccgtgcctcatatcccaataataaccaacccatccccatacaagagttcactaaccatactctaaatggtatcgtattgaaagagtttgttgtattcaattcttgcacaattcgtgtagattagaatgcagcaaaagtcttgcacacctaggcgtgcgatgcgatcgttaggctctgtgtacgagtatcgcatcgcacaacaacccactgaccaaccccctcgcaccgtcacgttgtctttcaggcagtctctcgtggcgtgtgcgcttgtttgctttgcaaagagattgccttagtgccttgttgcaaccatggcgtgcaagtgtttgagttgtggacatatgcgatcgattgcctcgcagtaatcggctacgataacgctgcctggtatctccgatgtacattgtcgttaacacacaaaaaacgtgcacgctcttgccaattaacgttaacgtagagtcagtattttaatattaaaaaggtttttttcttttttttcaccacccaataaactaacaattactggtgacatttgttgtttcattttatacatcctgcatcctgctacaaccttttacacaaactgttaggtagagtgttttgttaggtagagtgttttgctacagttaggtagactgtactgtaggttgttgtgtgttaggtttgatgcaaacatacaaatatacaaatacataaaaccagagttaccactagggcttgagactataaagttgtgattgagtatagagttactctttgaagagtattggtattctgaggagtattggtagtctacaagtatcctgccctgcaccgagcaccgagtctacactgcactccgagctacactgcactccgagtctgcatctgcatctacaagctacgcacacgcatcctgtctgcctacatctacaagctacaagctacaatctacagcaccgagctccgagcaccgggtctcaccaaactaaacggtacacgcaacctctactgtggtatcccagagagtgttggagtggtgcctttagttacctaccataaaagagttgctagaactcagagtagacataggtagatccaagagtagagctagaactcagagtatagttaaacccaaagtagacagagtagatgcctagtatagataccagtatatgccagtctgtgtagctagcataggaggtagtaggtaaaggttttggtttggtaactggtttggtttggtaaagaggttatacacctacacaccattttacattcttaaaaaacaagaatgtacaatggtataaaataatataataaaataggtacctaatgtaaacttgcaatacaaagctaaccatgcaactattataaaactacaactaggtactaggcacctaattgtgatacaccataccaaaccttctatcattccatctgcatccatccatctatatatctacctcctctaataacaaaccaataccatccaacacccaatcttaccaaaaccaacaactcgccattagccaccctagggcacctgcacaattgcactcaaactctgatgttgctcagacagtacgcgtaggttgtagagtctcaaaaagtcgtcaaatgcaaactctttggttgggtgaatcttgtgcaagttcaccttgttgtgcaggtcatagattcgagtaactggatcgctagtcagtagcataggataggtgattaccatgatgggttctagtttgtcatagttttcctgacacatgccgcacactagaatcagactgagattgatgagaatgctcgcaaaggccaccagtagctctttgtcgttctgagccagaatactggtcaggtgcagaaagcgccaatacgtgtgaccccaccactctttgagcttttcaatatcaaccggatacaggccatagtggtcgatgacaaacttgtaaaactcggcagaagtgtctgcatcctgcttgatgcgcacaaagtactcggacaccttgtcaccatcaatcttgggtcgcttcaacagtacactgagcatatcgaaaaagtctcgtttgtagtcgcacaccaccagattgtacaagtcggtgggaatcagatgcaccacataccagagcatcttggcggcagagactcgaacctcggaagtcaaccgttccggatccatgcacgcgtagatgcaaactctgtacgtgccctccaagcgcttcggtgtacgctccttgtacagcgccagtgttgaatcttcgtcgtcgttggccatgttggggaatctaaaaaactagagtggttgatgggttgatgggttgatggattgatgtattggtacatgtatttgaagtatgtttctaaaaaataaaaacacttgtgtgtctaaaaaatgagccttttatttattaatataaaacctttacatgtactttaagataatacaagatactacaagatactccaagatattctaaaatactctaaatatttgatataggtacacatgtgtataaatacaggtacactacttaaatctaatggcaatacacatggtggttacaaacaactgccaagtaaattgtaggatagtaaattgtaggatacatttattctgaattcataccaacaccagccctaaacaggctaacttctgaaccatagtcagagtcggaagccaacgaactctgcgtagactcggaagtgatgctcgaacacgaactgcacaaacgacgacgacgcagtcttgaactagagcgcagcttggcacggtaatcattatttgggttgcttatgctggtgggtgcacttgcaggcggtaggatgacatccaccatgtcttgtcctgtaggggtggtagtaggtggcggcggaggtgtaggactacggctatcggcacaaccaccatctacactgttagacttgacgattccatcattggcactactactagacagtttacgataggcggcctcttcggtatagtctcggttaaagagtttgtttacgcgacgcaggcaacgattcgagatgccaccggttgctgttgttggtgttgttgccggttctacgctcttgcgcttagtgggcctaatcttgcacttggccatgtagcgttcctcgacacgcttcaagtcggccatcaactgttcggcaaagcgtctctcaaactcttgaacatcttcgacaccaaactctcgtcggatctcttcgtcaatcattctaagtttggcgtcttgcaactcggcctccttttgcaattgcaactcttgcagttcggcctcttgccgattgagctcctttaggcggtgctgttgtgccagctcgtgcatcggcctagtaccgcattcatcgaatccctctacgcatatgggatcgtgttcaaacgaatagctactgcggctacgcaccagattggacacggccgctatgggtctcttgaagagtcccatcagtgcactcaataggttgttgtttgagcgattcatagtgtacaagagcaagttggaaatttacaatctgtaggtacaaggtgtacagtacaaggtacaatacaatacaaggtatgcaatacaaggtatacaatacaagatgcaatacaagtattggtatcttgcaatcctctatagtattattagcagtggaagtagcctatatatatttattaaagctttaggtaatactagtagcctctgtgaatagtgcaacagtccaagtacaaataccatattgcggtaaagctgcaccagttttataccatgttgtggagaaaatgtagtaataaatgttacactttgaagggattaatccggtccgttatccactgccacacattaaaggcaatgttggcgtacgatacactgactagtgcaacgctcagcaggagcatcaagactccgagtaggtagactcgtaaaactatcaacacgacaccgataccgacagcgatgcccgtgtaccgatttatagtgtcaaaggcctgtctgcgtagcttgtgatgagactcgtacacttcaaagtcttgcactgtaaacagtttggctcgcgttagaatcttttcaaactctatcgagcccacatcgatcacgttacccttgttgattcgagctccgtccgagttgacttctagggcgtccaagtagcgatacgtgtatgtgtacgattctatgctggcatcgaacaaatcctcctcggtcaataggaacgagcacacgtagtcgaacgtcagcaccggtcgattggtcttgagctgagagcgcaacgccatctttgagttttcgtacagctggtgcaggtagtcgggcgtgtacatgttgttgaaacccaacggatcccagaacgtgagcagtatgctaaagagttgcgttatcagcaagactacacccacaccggtcgaggccatggccagactcttggtcaggtagacaccgatcgtgcccagactgcgcaccgtcagcggtaccaccaagtctcgtacggccactttgaacgatgcacccaacactagttccgaggtgtcgatggccatcgtggcgaccttcttttgtagcaacggcaccagtttttgaatcgccttaaccgtcatcgtctttagctgactggccagttgagtgacgcccacgtctacagcaacgctggcggcaaagtctgcgctggtcagttcgttgagcagcgacagtatgatcgattcaaacttggtctgtttgccagtctgcgaggctagggcatttttgagttcacgatccgcacccgatgtatcgttgaggctcttgactagatttaagagtttttcaatgtcttgatttttggtagtactagtactagtactagtactaggcttggtaggctttggtttagatttcatcatagcatcatcaaatcgtacaattttaacattgtcagccattggtatagtgttgggactcctcttgcttctgtggttcactcggttcattgtttccaaatcgctcacggtcacatctatgggcggtagtttaaaattgggatcgatgtttttacgccagcccgacactgtccatttgtcgtctatggccggaggtggatccttttcgagaggcggtaaagttttgccgttaccgttcgacatggcggtcagaccggcatttatcagcttgattacggcatcgcccactattatgttggccaatttattataccatttagtgtagcaggtacgagtgtcgggatcgaacgcttcgtagtaaacgtcgcaatagtatttgttaaagtgatacgtgtccgtggacggctcatagtcaaagccggtgtcgagatcgtttagcctaggcgcgtacagttcactggaccgataccggggaatctccatccaggtggctgcaaaaggtacgatattgcaagtgttgctagtctctgaccaacggtagcgaacgttgtgtggcttgtcggtaccgtcatcggtgtgcacggccgtttcgaacaagtggaagcaggccggattgcattgaacctcaaagttttcactctcacccaatctatagtagctggccgcatccgtctttttgcagggtccgtgcacaccggacgagttgcacgaaatgctctcgcacaattgttttgtaatctctgcctctacgaatatggcctcggaggccattgccggtggaatgtaataatcggcatcggtggccgctctgacgttgactttcaagtgcgacgccaagaagggatacttttcgttgagcttgtgcagtagcatcaagagtttacgatggtacgaaaacttggaggcatttgcaatgtctaattgggtgtaggttgtggtggtagtggtagtggtagtagggtttgttggtgttgtaggattaggattagggttaaggttagtaggtacagtagacattgttggttgtgtggattcattaacctagcatatacatacacacaaacgtgatatttatacaaagatttatacctaatatttattaagtactcgataagtacaaagattcaagtacctagtactactatggggaacgtgcacacacagactctctcttccttttgaaggaatttaaactttttgtacaataaaattaacaagcaagattaatatgcaaatagcaataacgtgcaggttaatatgcaaattttaatgaggagttcaacttatgagacttttatgacaatatcaagttttgtaaataaaaggttattttcaactgcaacaatgtgtgatgcaaatttgagtttgtacagagtagctctattaaaaaagaatactgcaagcgttgttcattttatacacaacttgtcatatacgagtactagtaacactactagtaccactactacaactagtacaactagtactacaacccatcatagaggtttaccaattcttgtaatctttcaatcttgtaatataaactaaaactaaatattcttacattaccaattctctttacaataccaattcttacaataccaatcatcattatacaataccaattcttacaataccaattcttacaataccaatcatccttacaattattacaactgccaattatagctctatgtagctctaccaccagctactacagtctacactctacacgctctactacatgatccagtacatgctccactctacacactacggcactcggcacgctccactcgacacactctactctacatactcttatcctaatactcttacaaatatttaaacaacaaataacaagcaatagcaacaacataggcggactttaagactttactgtaaactaggatgttcagactactttgataaactaggactttaaaacaaattgatacattataataaaagtacaacaaaagtacaacaacccactacctcccttcaaacaccaaatcccttggatctttacaagtactttaaatttccaaacattttagatccatgattaaagtacaagtctatgcgatccggtagcaggcttagcgcagtcttgaacgctctcgaatgatcacgttctttgggatttagtcgcaaatagaatgtatagtcgcctatgtagttgctgggcttgtcgtccaccaggcacgagtatgtaatcattgtagttttaaactttcgattcagctgcttgagtacaaaaccgatgcccttgttgaagccgtacgatgtgtggtacgatctcgtaatgacaatgtcaaacagagaatagagccgcaaccgcttcaagtgtccgattacgtgaccggggtctccgtgcgaccacaccaccattcgtttaaagtgcttcttgaactgcaacaggtagtggatgagatcctcggacgttagcgtgccatcgtcgttgatgagcgtctcgtccagatcccacaccaccaccgattcgtgccgttcgatggattgcttaaaggttctgtacagcttgataatgtgagagatgagcgcttcgctagtgggaaactcttcgccgtttacatagtctacgtacaagttttgctggatcaggtagtcgacgttttcaaagtagactagcaccgagtaaccaatggatctggcaccggtctcgtcccatttcccctggcacactttgtcgttgatgaccaaattttgaaatacactggccaggttaaagtgaatcaaacgattccgcttcttgtagttggaatcgactattctacaaaaagacatggcgactgcatctggtatacgttttaacgcgtacaacgagcatattcaatattcgatataggtcataagacgtttaccctattgccggttagtacatgttcaaacgactgggaccgcctccggtgggcgcctcggtacgcatgggcacaatgtccagaaagggtggcaacttgagattttgagccaaggcttcgcgattcatgaccgtctgcaaattgaccagattcgatacgataccgttcagagtgctgtgcggtagcatctgcaccgaggcactcctcggcgtatattgaaactggtaaacgtttgcgttggccaacatgtttacctgttcggtggacttgcgcactagatcgttaaagacggtaacgtaggcgccctcctcgggcttgtacgaactctttacgttgaccctgcacgttgtgggattcatagtgttggtgatgggctgttccactttgctccggagccagaaaaagatgctattcttaaagtgggcaaagtttttgttcttgtacgcactgaccgcctttaggtactcgcacagtatactctgcaggtgaacgtactgctcgtcaccgggcgtactgttggcaaagctctcaaaggcgggcagtgtcatgatttttgaaaaacacttggcaaactcgccgacggtaaaggttcgcttcgtaccgatggtggtgacggcgtccaccacatcgggactcatgtagttgcgattggccttgtaaatgtttttcaacgtctcgggatcggcgacgccactctttataaactcttcaaagagttgcttggtgcgatcctgttcctcaaacatgattgcgatacactttgtatacgatcggtgtacatagcatctacattattatgcaaatttcctgatagatgcaatagtctattgatcatcagatggtcggaaactttgacaaggagctatcggtgcacaatgcgcaaatatattcacctgttgcagagcaacaaaaacagtaaagtgtacagcgtcgaagacctggacggtacactttacgtgatgaagattataaaaaatcccagtacactggtagagattgaggtgccctacaaactcaagcgtctaacgccctgggtcatggtaccgtaccgggtaaactttaaaaaggacaaactagtcatctactctagctatatggagaacaaggacctgactcacaatgtgacatcgatgagttgccagtccaagctaagggctctgctcaatgtggccgaagtgattcagtgcatgcactccaaattaaagtgtatgcacaacgacattaagcctgaaaacattttcatcgatcgctacaagaatgccaagctgggcgactttggcctgtgtcggtacaaggtacaaaactgcaccgctctaatgggcacatcccgatacatgtcccccgagaagttgtcgtcttcgtacgattaccgttcagatatatggtcatttggagtgactgcttattactgttttacgaacggggccctaccgtttcgcatatcggacaattgtgaggatgctcgcaaagtcaactggaccatgcatacggaccctctgaaggtggtctttgatcaagatttacgagaattgatagtcgagatgttgacgtacgacattagccggaggttgaccaatttgagtgagattatagagaggttaaagatggtttataaaaagtttgaaaattatgttagttagagggggtgtagagggtagctgtggatgtgtatgtagatgtaggtagatgtagacgtagactcggcagcgagatttggttgtattagttgcatttatacatggtatttattaacaactatattaactaacttgtgtatattttgtatatatatatattttgtatcaacctagttgtacaattgtcattaggtacctattttttagacactcataaatgtcaaactttgtactctttaaactctttaaaggttcccctctaaagctaaacaaacccaagatgctaaccatcaatataacgtatccaccgaggcccaagattccgataaacctcatcgtggccgtgtgtgaaaacaacatgggcatcggtatgaacaactcactaccctggcacttgaagcgtgaaatggcacactttaccaagaccaccacgacggcaacgcaccccaacaagaacgcagtcataatgggccgattgacttgggagagtataccgaaacgattcaggccgctacccggtcgggtaaacattgtgctgaccaccaagcaccgaggcgactacgatggagccacgcgagtgtcaaactttgacgaagccatcagagtcgtcgagtctcgtggtgacattgagaccgcctgggtaattggaggagcgtccgtgtacgcagcggcaatgacccatcccaattgtcaccaaatacacttgactgcgatcaaaaagtattacgagtgcaacgtctttttccccaagattgatacgactcgattcgagctaatctctgaaacgccgtgtacgcgcgaaggcgacgttcaatattcctacaaagtttatcaacaacgaaacacacacgcttccatctaatatgtgcgtgccgcgataacgtcaatacgctattgttgttatatgtgagcagtagtattgtagttcaacgctttttgtgcaagtttcaagtttcttttagatgcctcgaactttgttgcattctgaagtggacgcagtcagttggtgtattgttgaatatgaaattgtggaatatgagatttatgaaattgttgaatacgagattgtttgaaagtaggtttattttccaagtttaggattcagagcaccctttgtgtgtctattataatatacatgtatatacaattgttgttaatcattctttataggatgaaaaggtgtattgtgtatagtagtaggtagtaggtagtaggcaatggggtagtgtgttgtaaaataaattgcttagaataaattactaggaactgcaattaggtgcaattagaatatgagggtttaatttaatttagttttttaaagaaatcatcacttgtgttgattgtcataaatggcaaccacacacactcttggaaaaaagagggtgcacttgcagatcgtaaaagttgcaataaatttcatcaacctaatcccttgcacatgtagtagggtgctcttttatggtaatatgcaaaacacatgggatctaggtttgatgcgttgacatttattacaacagtctgagatccttgaaaaatccaatacaaaaaagtatcgtaaattatcgatggcgtgtgacgtaacctcttgcgggttttatagcttttctcgaaactctgtcccgagactgggtttatggtttttgtgtggttttttgtgagctacatgtatagctgggcacagctcactcttctggatgtcataaaacttaaagtttacgatgcccactttatatttattgcaaaaaacttggtattgtaggaaacaaggacaccgataagggaaagatgcaggttgccatcgtaaagacttatcatggaaatcaaattgtttccaccggtataattgtgctttcatttaatacacgctagacaaaggatgttttaaaattagtttttaaaagaatcaaaggaaaagttgcaaagttgtacacaaagcgcatcctcaaactgccaacagcatctaccacccatagtctagatttttaattgggtttcgtaactattataaaaacgctttgtgtaatgtaaaagtgtccgagtcagagtgctaggaacctttaagagaggagagaaactcaatttacagtaaaatgcagtttagcactagaatggcctgaaacgctatgctacagttttcaaaacacacgcacacacatcaaaagactttgtagtgtgagagaaatgaaaaaaaccataccagccagggcagcatgtatataaacggagcagtcttatcgcatggtttcagttaggcgcgttcttttgatcgataaatgtcagattttagtttagttatggtttttgactgaaaacatagactgattgtattatgccatggtttatcaacagatgttagtacgagtaggtaccagtatattggtaatcaaaatatttcatacacgtgtaaggctctagcaacaacaataacaaagggcagataagggggttgccacaatacgcatgataggaaatgcatagattagtcacggaagttcctctgtacgtgcaacaacaaagtggtgcattactgtaattagcgataattatggtaaccacaattatgaaactacaatgcattgattcataatacaccccttatcaccagtggtgtagattatattgtattataaattagttcatgactaggttagtcgcttcagtcaatcgcaaagcttcttatggtcaacttccggcgtagggtttgtgtgctcctgtttgtgcgagtattcagttgagctcctccctctctgctaatgtgacaagtgctctctctcttggacagtgtgtgtgtttatttacaaacaatgaaaaactctatagtttaatgacttgattttcgattcgtgcatcaaaggtgtactattagtttcaaaggtgtacacaaaaaaaatagtgtaaaacaatggtgtgctacgcggacacaatggactctaccgatgcgtttgatgcaccctctccggtgcagaaagagtttagcctggtcgaatacattctcgatgaggccgaggaacgtcgccgactcaatcgagagtgccgaagctatcgtgaattcaaacgtaggctaaagaatttgaaacatcagcgcgaagccagacgtcaaagctttgactcttcgcgcgattctacaaccaacgttagtatcgttaccaatacgagcacttctacggctgctaatgatgatgatgatactgttgctacggctactactgctacacatggtgatatcgaggctgctagaaatgtggctgctacaacaacaacaacaaaatcaaaatcaagaccaaagtcaagatcaagatcaaaatcaataccaataccaatgctagtaccaatgacaacaactgcaaatgcaattgctacaactgtaaatgcaactttaacttcaacttcaacaacaacaaacggactccttaaacccctcaagattaagacgaagcgaccccacattgaagactcggatactgacgatgccgactacgcaccaccagtcaattacggtaaacgtcgacgagtctctatgtctagtgtgcctagtgtgccttctaatgccaatactaacagtaacagcaacaacagcaacaacaacaatagtagtattagtattcacaatggtgttaaaagtaatgctaaaagtaatactaaaagtaatggcactaatgtcaactctgtgcatccaccacccaataccactcttgctaacccttgtaaaattcaagcacccaccaagaatctagacaagattcgcgaacagcgcaaacacgatagataccgtaagcgtgatcgcaaacgcaaagcggagcccattgtagactttgatggggctgtcaataaattgatcaagagtgaactcaatgttgatgtggaggtgatgccaccgcccagtattaaaccgcgcaggaaaaaggccaaggctacgtgcaagtattgtcgaaaggtaatctctaaccgttccaatctgctgcgacacgtaagggatgtgcacaagaaggacactagccggtacgatagtcagtgttcctctagcgcagaggatttgattcagagcgataataacaacaatttcagcagcaacctaaagagggctatgcttcatggaaaacccaacaaaccggcagctgttgagaatatagtcatagagtgcacaccctttgacgatggcatgatgtacaaacactttatggcagattcggacgacttggaggatgaggtggtagagaaggagcccgactattataatgtcaaaactccagacttgtttcacgatgaaaagatgaacattccaaagctgactagtgctcaaatacacggacccagaggcaacggtgtagacaatggtatagtctacataaaggccgattcctatgccgccagtattaacttgttcaactgtcagggtattaaacgtaaggataagggtactagtgttaagaatactgcaagtaaggatactacaagtaaggatattacaagtaaggctgttacaaataagtctattacaaataaggatacaattaaggatataaacaagactaatgatgccagtataactaaaagtacaaatgtaaacaatagtgtaaatagttcaagtttaaatgaagaggacgaatctcatcaatctatgcctgaatattcaaaccctgaatattcacaacctgaatattcaaaccatttaaatgataatgtaaatgaagatgtacatgtaaatgaagatgtaaataagagtgtaaatataggtgaagagtgtaatgataatggaaatgagcaaagtgatgtggagcaggtcgacgaactggatacaatcaataatgtagacggtggtgtggaatctaatgtagagatggagtccaatgtagagatggaatcaaatgtagatgaggttgaacaggaaaattcacaagaggtgtcacaagaggaggtaacgcaagacgagtctcaaaatgaggccaacgaggaggccaacgaggatgatcaatctcagaacgaggaacatgacacaattgatgatgatgaacagccagaggatcaacaagaatgcaccgaggagcaagaacatactgaggaacaacaagaatgcaccgaggaacaagaacactctgaggccgagcccgaagaaggctccgactccgagtctgaatctggctccgaatctggttcgggctctagttcaagctctgactccgactctgaatcaaactcggacgccgaatccaacgctgaatcggaggatgaggacaatgcatccgagcaaccgactgaagccaaagtagaggttagtggtgtggatagagtcaatgatgataccgaagagtgtgttgttgtagagagtgtacagccagaggaggtggccatacaggagatggctgaaattgaattacccaatctagaattggaacatgaattggatgactttccagagccagagggtgctctgagttccgacgacttggaaccgaaacgtgtagacttgcagtgtgagcttgacgagctaatgaacgaccacgtggcattttccaaagattccacaatagaggcctttaacaaaattgatgaattgttatcgacaattcaaccattaccaatgagtacaatggaaccattagctgacgatgatgttaatgaggacttaaacagtcttgcaaataccatttctaatgcattaatccctaatgggtgcaatgtaatctccaatggaatgcagccccttgttgactcaggttggtatttgcacttttgtgtttactacacgctctctctctctctacactatactgcacactatactgctacaactacctgatttactacctggtctactacctgatctatacctgatctatacactacacacatatacatttataaatacatttataaatacatgtacaactttacaataccagacggaatctacactactgaatctaacactacactactgaatctacactgtaccaattcatctacactgctacactgtactactttttacgtccacctataccaacatttacttgtaataacaacatttacttgtacgtacctataacaccatttacttgtataaatctcatctcgttttttagactgtgcattttgtgtacctacattgaaaatgtcctacattgaaaatatcctacattaaactgtgtctaccattgtatgtgtatgtaacctaaaactgtactcatcaccctccattctcatccatttcagattgtaaaaacatcactggtgcgggcaacggctacaactatattgtgcatccccataacaccaacaatctcatcagcaaccccatcatcagcagtgtcaataatccatcgaccatcatatcctccttcggaatgaaatcatctgaaagcgtgccaatcaactctgcgggtgactctatcaatctgtatacacttgcatgcgtagcggataatgttcagtacaatagtaatactaataatagtagtagtgctagcactagcaacatcaatggtgcatctttgcctccgtgcggtaccctaagacgcgctcaggatactgcaaccagtgtcttgatatttgattgtaagaatgtaacttttgaaccgagcaacaataccttttatccaaccggtcccaatctgttgaccaatactgaatctgagcttgagctagaggaagagtctagcgtatcgggtattgccgacttttcaatgtacattcgcgatatgcaaaacgatgacccgctcttgtcaccgatgctgtcctccaacggttcagagaaacagctagagcaagacttgatggtgaccacaaatgacttgaatggtaactgtaatttgactgacaactcgactggcaacaactttgaagatgctccaatggacattgatggggcaagtgtaggtactttacagactactctagagacggtagaaacattacagaccaagactgtagaaacattacagacgacgactgttgcaaagatggacgagactgagactgtaggtaacgatactgttgtaaatgtaggcaatgattcaatacctgcaaccatacccgaacccaatcatcctaatcctttacccgaagctggggtcaatgttgaaactaacaatggcggtaatggtacggtgtctactaataaaactaatgatactaacagtactaatattaacaatactaacactactaacagtgctaacagtactaacagtactactaacactactaacagtaatgatattgaggggactaacaccaacattgatgccaatactgctacaactaatacaaacaccaacaaccacaacaacaccaaaccctcctcccccatccatcgcagtgtattgaatcaattcaaaaaagtcattgaacgcaactcgggctggtccaatctggacgagctactgttcatggccgactatatagagcccacgtccaaagtgtacatgatgcacaactttaaaaagcttaccactctacaagattcggtatcggacattgaaaacttgatacgcaccgaagtcaaacagtccatctcaaagaccaccctggactatttgaccgcggtggtcgtgcactacattcaaacgtttgcagcctctatgattatgtgcaatctgagaatgggtaggaagacggtgtcgagtgcatcctattgcaattttgccgagtacactcgcgacttgacgatgagtactcaagagatgcttctattggaattgtccacgtccggtgtgctgctaaacttgccaactgtagaatctataatcttgaagggttttatgcatgcgttgcctcatcaacacttggacgcgaacagtatcgaacacgaaactggtattctaaagatgctctacaacattgacttgactgacgagtttttacaagttattcgttcctacgccattaaactgatcaagtctatgggctttatgctcaagcgcgaaaacttgacgcagatagatttgtgtcaattgagcgacaccctaaagcgacactctaacgtgttcaaactcagatcatttctcaactttgatatgcatcctagtttgtgacttttaccattaaactttgtgtactttgaaatgtgattttgtgaaatgtagaatgtgattttgtataacttgtaatgtgattttatgaaaagacttgccaaaattgtaaattgagatttacattttcaaaaagtgtaaatgtcgatatcg

SEQ ID NO: 2 - DNA, 228089 bp, Helicoverpa zea nudivirus 1
  misc_feature (200144)..(200144): n is a, c, g, or t
  misc_feature (200346)..(200346): n is a, c, g, or t
  misc_feature (200437)..(200437): n is a, c, g, or t
  misc_feature (200544)..(200545): n is a, c, g, or t
  misc_feature (200581)..(200581): n is a, c, g, or t
  misc_feature (200583)..(200583): n is a, c, g, or t
  misc_feature (200594)..(200594): n is a, c, g, or t
  misc_feature (200601)..(200601): n is a, c, g, or t
  misc_feature (200616)..(200616): n is a, c, g, or t
  misc_feature (200618)..(200618): n is a, c, g, or t
  misc_feature (200630)..(200630): n is a, c, g, or t
  misc_feature (200632)..(200632): n is a, c, g, or t
  misc_feature (200636)..(200636): n is a, c, g, or t
  misc_feature (200641)..(200641): n is a, c, g, or t
  misc_feature (200644)..(200645): n is a, c, g, or t
  misc_feature (200652)..(200653): n is a, c, g, or t
  misc_feature (200656)..(200656): n is a, c, g, or t
  misc_feature (200663)..(200663): n is a, c, g, or t
  misc_feature (200666)..(200668): n is a, c, g, or t
  misc_feature (200676)..(200676): n is a, c, g, or t
  misc_feature (200679)..(200679): n is a, c, g, or t
  misc_feature (200690)..(200691): n is a, c, g, or t
  misc_feature (200695)..(200696): n is a, c, g, or t
  misc_feature (200698)..(200701): n is a, c, g, or t
  misc_feature (200705)..(200706): n is a, c, g, or t
  misc_feature (200709)..(200709): n is a, c, g, or t
  misc_feature (200714)..(200714): n is a, c, g, or t
  misc_feature (200716)..(200716): n is a, c, g, or t
  misc_feature (200718)..(200718): n is a, c, g, or t
  misc_feature (200720)..(200720): n is a, c, g, or t
  misc_feature (200722)..(200722): n is a, c, g, or t
  misc_feature (200724)..(200725): n is a, c, g, or t
  misc_feature (200729)..(200729): n is a, c, g, or t
  misc_feature (200738)..(200738): n is a, c, g, or t
  misc_feature (200746)..(200747): n is a, c, g, or t
  misc_feature (200756)..(200756): n is a, c, g, or t
  misc_feature (200762)..(200762): n is a, c, g, or t
  misc_feature (200764)..(200764): n is a, c, g, or t
  misc_feature (200768)..(200768): n is a, c, g, or t
  misc_feature (200771)..(200771): n is a, c, g, or t
  misc_feature (200777)..(200777): n is a, c, g, or t
  misc_feature (200780)..(200780): n is a, c, g, or t
  misc_feature (200782)..(200782): n is a, c, g, or t
  misc_feature (200786)..(200786): n is a, c, g, or t
  misc_feature (200791)..(200791): n is a, c, g, or t
  misc_feature (200795)..(200795): n is a, c, g, or t
  misc_feature (200802)..(200802): n is a, c, g, or t
  misc_feature (200804)..(200804): n is a, c, g, or t
  misc_feature (200808)..(200808): n is a, c, g, or t
  misc_feature (200812)..(200812): n is a, c, g, or t
  misc_feature (200815)..(200815): n is a, c, g, or t
  misc_feature (200820)..(200823): n is a, c, g, or t
  misc_feature (200833)..(200834): n is a, c, g, or t
  misc_feature (200836)..(200836): n is a, c, g, or t
  misc_feature (200839)..(200839): n is a, c, g, or t
  misc_feature (200842)..(200842): n is a, c, g, or t
  misc_feature (200845)..(200845): n is a, c, g, or t
  misc_feature (200848)..(200848): n is a, c, g, or t
  misc_feature (200850)..(200850): n is a, c, g, or t
  misc_feature (200855)..(200855): n is a, c, g, or t
  misc_feature (200857)..(200857): n is a, c, g, or t
  misc_feature (200861)..(200861): n is a, c, g, or t
  misc_feature (200864)..(200865): n is a, c, g, or t
  misc_feature (200870)..(200870): n is a, c, g, or t
  misc_feature (200873)..(200874): n is a, c, g, or t
  misc_feature (200881)..(200882): n is a, c, g, or t
  misc_feature (200887)..(200887): n is a, c, g, or t
  misc_feature (200889)..(200889): n is a, c, g, or t
  misc_feature (200895)..(200895): n is a, c, g, or t
  misc_feature (200897)..(200898): n is a, c, g, or t
  misc_feature (200902)..(200902): n is a, c, g, or t
  misc_feature (200905)..(200906): n is a, c, g, or t
  misc_feature (200910)..(200910): n is a, c, g, or t
  misc_feature (200916)..(200916): n is a, c, g, or t
  misc_feature (200919)..(200919): n is a, c, g, or t
  misc_feature (200921)..(200921): n is a, c, g, or t
  misc_feature (200925)..(200925): n is a, c, g, or t
  misc_feature (200929)..(200930): n is a, c, g, or t
  misc_feature (200934)..(200934): n is a, c, g, or t
  misc_feature (200936)..(200936): n is a, c, g, or t
  misc_feature (200939)..(200939): n is a, c, g, or t
  misc_feature (200946)..(200946): n is a, c, g, or t
  misc_feature (200955)..(200955): n is a, c, g, or t
  misc_feature (200961)..(200961): n is a, c, g, or t
  misc_feature (200966)..(200966): n is a, c, g, or t
  misc_feature (200970)..(200971): n is a, c, g, or t
  misc_feature (200975)..(200977): n is a, c, g, or t
  misc_feature (200982)..(200982): n is a, c, g, or t
  misc_feature (200984)..(200986): n is a, c, g, or t
  misc_feature (200990)..(200990): n is a, c, g, or t
  misc_feature (200992)..(200992): n is a, c, g, or t
  misc_feature (200995)..(200995): n is a, c, g, or t
  misc_feature (200999)..(200999): n is a, c, g, or t
  misc_feature (201001)..(201002): n is a, c, g, or t
  misc_feature (201005)..(201006): n is a, c, g, or t
  misc_feature (201008)..(201008): n is a, c, g, or t
  misc_feature (201010)..(201011): n is a, c, g, or t
  misc_feature (201015)..(201015): n is a, c, g, or t
  misc_feature (201017)..(201017): n is a, c, g, or t
  misc_feature (201019)..(201019): n is a, c, g, or t
  misc_feature (201021)..(201021): n is a, c, g, or t
  misc_feature (201025)..(201025): n is a, c, g, or t
  misc_feature (201027)..(201027): n is a, c, g, or t
  misc_feature (201032)..(201032): n is a, c, g, or t
  misc_feature (201036)..(201036): n is a, c, g, or t
  misc_feature (201040)..(201041): n is a, c, g, or t
  misc_feature (201043)..(201043): n is a, c, g, or t
  misc_feature (201046)..(201046): n is a, c, g, or t
  misc_feature (201049)..(201049): n is a, c, g, or t
  misc_feature (201059)..(201061): n is a, c, g, or t
  misc_feature (201064)..(201064): n is a, c, g, or t
  misc_feature (201073)..(201073): n is a, c, g, or t
  misc_feature (201080)..(201081): n is a, c, g, or t
  misc_feature (201094)..(201094): n is a, c, g, or t
  misc_feature (201098)..(201098): n is a, c, g, or t
  misc_feature (201101)..(201102): n is a, c, g, or t
  misc_feature (201107)..(201107): n is a, c, g, or t
  misc_feature (201118)..(201119): n is a, c, g, or t
  misc_feature (201127)..(201127): n is a, c, g, or t
  misc_feature (201132)..(201133): n is a, c, g, or t
  misc_feature (201143)..(201143): n is a, c, g, or t
  misc_feature (201150)..(201151): n is a, c, g, or t
  misc_feature (201160)..(201160): n is a, c, g, or t
  misc_feature (201169)..(201169): n is a, c, g, or t
  misc_feature (201171)..(201172): n is a, c, g, or t
  misc_feature (201176)..(201177): n is a, c, g, or t
  misc_feature (201183)..(201183): n is a, c, g, or t
  misc_feature (201191)..(201191): n is a, c, g, or t
  misc_feature (201194)..(201194): n is a, c, g, or t
  misc_feature (201201)..(201201): n is a, c, g, or t
  misc_feature (201203)..(201203): n is a, c, g, or t
  misc_feature (201209)..(201209): n is a, c, g, or t
  misc_feature (201246)..(201246): n is a, c, g, or t
  misc_feature (201248)..(201248): n is a, c, g, or t
  misc_feature (201251)..(201251): n is a, c, g, or t
  misc_feature (201255)..(201255): n is a, c, g, or t
  misc_feature (201265)..(201265): n is a, c, g, or t
  misc_feature (201267)..(201267): n is a, c, g, or t
  misc_feature (201276)..(201276): n is a, c, g, or t
  misc_feature (201301)..(201302): n is a, c, g, or t
  misc_feature (201314)..(201314): n is a, c, g, or t
  misc_feature (201316)..(201316): n is a, c, g, or t
  misc_feature (201320)..(201321): n is a, c, g, or t
  misc_feature (201324)..(201324): n is a, c, g, or t
tcgagacttgctcctgccctgttctacactgcactgtggtgctactctaccggttgctctgagcgactcgtactctggtgtgcacttttaccagtaaagtaaccaggtgactttaaaattacacatctctgaactctgcctgctgtgttggtgtggtgtatgctggtgtagtgtttgctggtatagtgtttgctggtgttgtttgctagtggcgtatactggtgttctgcggctgctgtatactagactagtgttttttgtagtatagagttagagttggtttgcattttagttttactttgcatcttagttttactttgcatcttagatttattttgcatgttattgtattttaggacttgcattatagtttgaattgtagttttagttgcatcccagttactcttgttatttaactctattttattattgtattactttactactctatccatttatattttgtattcttttgtgtactcttttcatttactcttagtgtactgcaattgtaaatttactcttattgtttatttactcttagtgtactgtaattgtaacaactggtgttagtagaagttgtaacaactagtgttagtagaagtagaagcttgtaagcatgaatcctaccggtaaaagtccccgttctaaaactaatccccagtactatcaacaacccgagtttgcatacaacaacttgatgtatccaaacacttatcccaacggctatgggtacaatttcaatccaatgatgcccgacactgccaccatctttcctggtactacaatctttcccattccaaccaccaatactaacatggctcatgaactcggtaatactgctgctcccaacattacgatgcatgacttgggctttgaaattcccgtgtttgatgttgccaataacaatcaagcagacatgtcaaacaatccatcatcttttgtttatagagacacgctaaacactccgactcccgacatgcaacatgcaatggaactcgaagaggacaagcttaaatttatgaggacctttttaaactttaaagatacccctagggcggctccatctatcggcaaacgtataaacgcggacggcactcctaaacgtagcggtatcgaaaccgatgacgaggaccaatgtgtagattacagcaattataataataataacaataacaacaagactacgtacacttccatattagacgacaatagtgtcatgactactgtagtaggtaaacgcccgcgtgcgcaggagaagggagaggcgctaaattcagtacgtgtcgagttcccgcgcaaagaggttataaattcaggtcaaggcaacacagaactagaaattggtttattaaacactcaatacgagatcgttgacgtgtccaaaatgcagagtcgtaaacgtacacatgaaaaggagaatatcggcggcggtaaagtgttacgtagtggttcggccggcatcaagactatggttacgcgctctactaccgcagcagagtcggcaggtaatacattcaccattgccaatactagtagcgctagcgcaactgctaccactgctagtagcggtagtgtttcatcttttaacactcgtccattaaacgcacacaacaacattgttacagttaaaccggtagtagatcaggccaagtctgcagctcaggatgcgactgtgatcaaacccattattcaaaataaaccatctgaatacagacacaaaaagtatgtcaagtttgatcacactgcaaacaagggctatcagacttacgacactgcggccaatagcgtagagtctaatgcgcaatttgactcgggtgtagaatcgatcgcgtccaacgctgctatggagattgacgatgtaaacggttcggtggaatctgtaacaactgtcaatgtaaatgcaactagtgtagtagagtccaacaacaatgtaaatgctgcaacaaaagaatatgcagcatcgaatgcatcatctaatacatccatgtccaatgtaccaatcaacttgtcaaacattggctctgatgtagaacgctcaatggaaaatttgcacaaagaggttgagaaggattctgtaggaaatgtaggtgctagtgtaaactctaacccacccaatgcgtccgaatcaaactctgagactgcccctaaaccactgattgctcgtaaacagattaactccactcaatccaaatcaccggcaccagagtcggattcggacagcagcgatgaagagagcagtggtagcgaggatagtggtagtagcgacaatgatagtagtggtagctcggactctgaggatgaagagccatccaatgcaaaggagccatccaatcccaaaacgacaaaatccaactctactgttgttgcttcttctgttgaaaacaccaaacctacacccaagtctcctaaacctgatcctaaacaaattactactattcctaaacctattgctcctaaacaatctgctgcaaaacccaaacccaaacccaaaccgaaacccaacccgaaatccaaacctccgaccaacactccaaccaacactccaaatcaaaatgttaccattatttttaaacaacccaccactcctagagtagactctaacggtatccctataccaaccgttccattgccgtacaagaccatatccaattctaaatccaaacgctccaagaaatacaagtccaaagagttcatttctgacgatcaagactcggacactgaaacaaccgaaaccgtttccaagtctaaatctggtcccaaacctaaacctaaaactgatgccgccaagtctaaatctaaagtaaactctgcacccaaacccaagcccagttccaaacctaaagcaactccctctacatttacaccaagccctgctccatcaacctttgaatccaacactgagccatctgcacctacacctacacctcctacaacaaacattgaaccatctacacctacaacaaacattgaaccatccacacctataacaaatagtcctgcaccatcaacctctgaatccaacactgcaccatctacacctacaagaaacactgaaccatctacacccaatgccaacaactcaaactctgtacccgaatccccagctcccaaaaccccggcctctccatacaaatcaccatccaccgatgatgtcgccaagtccaaaattgacaagagggaacaacagcgtaaatacctttttgtaaaggctcccgccaatgtgcccacagttagaactctgcccattgccaccaaggtgccgcgtattcataaaatctctagtgaagccggtggcggtagtagaattgccgccatgcgtgcagagcgtcttaaaaagtctcaaagtatcaactttataaacaagaatattatcagacgttttgctgaacgattgggcatagatagaatctcaaaggatgtctatccagagctgagtagaatcatagagtttttcatgaaggaggtaaagcgtcgtgtgactctgttggtagagtgcggtaagcgcaagactgtagagattcgtgacattaaatctattctaaagtctgtaggtttgcgtgtattggcagacgattacgattacgagggtagggatcctggtagtgcaaaagatgaaaagtttgatgtggcatacatgattaaattgatcaagtccaaatcgtgtaaaatgcaattcataccgactttgcctttttgtcgtgcctggaagaatatcgaaattcagatcgactcttaccaagttgtgcatctccgatacaggggccaggctctgttgttgatgcgagacgtgaccgagtgctatctggctcggttattggaggcggcctatattgtaatgttaaactcgggtcgtaaaactttaatggccaaagatttcaagagcatgattggtgtaaagatgaccgacacggtcaacctttaccacgccatgtttgactcgttgtatacatgagtagattattgttttttgatttatgttttatgtttggaggaactttggttctatttagttgttctttttgtactcttttgtattttgtactctttttatatttttgtaaccttttgtatttttgtactcttttatattacctacctacctactcttttaatactctttttttgtacttttgtattctttgtatagaggattatttagacattatatttagactttatatttaaaccttgtatttagatgtaataaagaatctatatttagatgaactaaaccttttattaaagacacttattatttaaagacacactcttgtacaccattccatttatactaaatgtacccgttattttacaagtgtaattttaatcatgttttacattttatttcaaaccataaatgtacactgtataataaacccctataaacaaacctcaataaatgcatgtgtaaactgtatccttggtattttactgattcctataaaccttgatccctacttgtgtttgtttacattttttgccagagtgccttcactctaaaatcatgatgtcaaacaaatcatgatttgcctagttagggatgtaggctaccattagatggtagtgctaggagtagtgctagcaaagagtctcgctatgcagattcaatacatacagccctataccgattcaatgcatacaaccaagtacagtccatacagtcaagtacaattcatcaagtgtatacagtcaacatagagattgatacactacctaaagatgacagacacactgttttgatgacacacaatgtttatataataaattcatttggtatcgccaccagtggtatcaccaccagtcaaccatcatataaacaaactagcatataaacaaactatcgtataaactatcatataaacaatatacacacgcttcctctatggagagtgcccaactagtactgagaagtacttgtgaagagtacctatgaaaagtgtgtatggcgagacttggtataaacaacgatgtaaattataaacaaaggcaactgccaactatacaactctaaacaaaacccgagaactgagactgagatctgagacctgagcaatttgcctgaggtttgaccttagagtgagagagggattaaagtgggtaggtagtattattatggcaatatgtgcgagttcaatgaaagacggcaattgacactttagccaagtgaatggtagtctgggaggcaatctggtaatgggttgcttgaatgattggatacaatgattggatacaatgattggatactttaaatgatacaagtctgattgattattgtaaacactttttattatcttgttgatatttcatcttgttgatatttgacatttgtatataactctactaggtatttaaatctaaatataaagtcaactttaaaatactaatataaacttgactctaaaatactctaaaaatactctaaaatacatttctataaaatagatgggcaagtatagtctttttcataggtggcacacaattcttaaatctacttcaatacctagtaacttttcaatagtaactttacttcaacagtaactcttaaacaataactcttcaacaaaactcttaaacactacctcttcaacagtaactttataatttaaactaaatcaatagttgaatctaactagcatactggccaactagaatactaaacaactagcatactaaacagctaacatactgaacaactagaataccaaccaactagcgtactattacattacttatcacttactacttactaggtaggtacctactacctactacatactacttacatctaaataaccatactcggttcaatcctaacactaatacatttgtactgtacacttgtgacattcacttgtgacattagtttcacttgtgatattagtttgacattcacttgtgacattggtttcacttgtgacaagaatagtatctaaatcgagtatcttaacgtctaaagtaaagcccaaaagtaaagcccaaagtacaaaactagacacggtaatggcaccattttaaggcatacaagtttgcagtctttgagatgcaaattgacattttagagcaccgatatcgacatttacactttttgaaaatgtaaatctcaatttacaagtttggcaagtcttttcataaaatcacattacaagttatacaaaatcacattctacatttcacaaaatcacatttcaaagtacacaaagtttaatggtaaaagtcacaaactaggatgcatatcaaagttgagaaatgatctgagcttgaacacgttagagtgtcgctttagggtgtcactcaattgacacaaatctatctgcgtcaagttttcgcgcttgagcataaagcccatagacttgatcagtttaatggcgtaggaacgaataacttgtaaaaactcgtcagtcaagtcaatgttgtagagcatctttagaataccagtttcgtgttcgatactgttcgcgtccaagtgttgatgaggcaacgcatgcataaaacccttcaagattatagattctacagttggcaagtttagcaacacaccggacgtggacaattccaatagaagcatctcttgagtgctcatcgtcaagtcgcgagtgtactcggcaaaattgcaataggatgcactcgacaccgtcttcctacccattctcagattgcacataatcatagaggctgcaaacgtttgaatatagtgcacgaccaccgcggtcaaatagtccagggtggtctttgagatggactgtttgacttcggtgcgtatcaagttttcaatgtccgataccgaatcttgtagagtggtaagctttttaaagttgtgcatcatgtacactttggacgtgggctctatatagtcggccatgaacagtagctcgtccagattggaccagcccgagttgtgttcaatgacttttttgaattgattcaatacactgcgatggatgggggaggatggtttggtgttggtgttgttgtggttgttggtgttgttggtgtttgtattagttgtagcagaattggtatcaatgttggtgttagtcccctcaatatcattactgttagtagtgttagtagtagtattattagtagtgttagtattgttagcattgttagtattagtactgttagtatcattagttttattagtagacaccgtaccattaccaccattgttagtttcaacattgaccccagcttcgggtaaaggattagaatgattgggttcgggtatggttgcaggtattgaatcactgcctacatctacaacagtatcgttacctacagtctcagtctcgtccatctttgcaacagtcgccgtctgtaatggttctacagtattggtctgtaatgtttctaccgtctctagagtagtctgtaaagtacctacacttgccccatcaatgtccattggggcatcgtcaaagttgttgccagtcgagttgtcagtcaaattacagttaccgttcaagtcatccacagtggtcgtggtcaccatcaagtcttgctctagctgtttctctgaaccgttggaggacagcatcggtgacaagagcgggtcatcgttttgcatatcgcgaatgtacattgaaaagtcggcaatacccgatacgctagactcttcctctagctcaagctcagattcagtattggtcaacagattgggaccggttggataaaaggtattgttgctcggttcaaaagttacattcttacaatcaaatatcaagacactggttgcagcatcctgagcgcgtcttagggtgccgcacggaggcaaagatgcaccattgatgttgctagtgctactactattattattagtattactattgtactgaacattatccgctacgcatgcaagtgtatacagattgatagagtcacccgcagagttgattggcacgctttcagatgatttcattccgaaggaggatatgatggtcgatggattattgacactgctgatgatggggttgctgatgagattgttggtgttatggggatgcacaatatagttgtagccgttgcccgcaccagtgatgtttttacaatctgaaatggatgagaatggagggtgatgagtacagttttaggttatatacacatacaatggtagacacagtttaatgtaggatattttcaatgtaggacattttcaatgtaggacattttcaatgtaggtacacaaaatgcacagtctaaaaaacgagatgagatttatacaagtaaatgttattattacaagtaaatggtgttataggtacatacaagtaaatgttataggtgggtgtaaaagtggtacagtgtagcagtgtagaagtatagattcagtagtgtagtgtagattccgtctggtattgtaaagttgtacatgtatttataaatgtatgcgtgtgtagtgtatagatcaggtatagatcaggtatagatcaggtagtggatcaggtagtaaatcaggtagttgtagcagtatagtgtgcagtatagtgtagagagagcgtgtagtaaacacaaaagtgcaaataccaacctgagtcaacaaggggctgcattccattggagattacattgcacccattagggattaatgcattagaaatggtatttgcaagactgtttaaatcctcattaacatcatcgtcagctaatggttccattgtattcattggtaatggttgaattgtcgataacaattcatcaattttgttaaaggcctctattgtggaatctttggaaaatgccacgtggtcgttcattagctcgtcaatctcacactgcaaatctacacgtttcggttccaagtcgtcggaactcagagcaccctctggctctggaaagtcatccaattcatgttccaattctagattgggtaattcaatttcaaccatctcctgtatggccacctcctctggctgtacactctctacaacaacacactcttcgacatcatcattgacgctgtccacaccactaacctctactttggcttcagccggttgctcggatgcattgtcctcatcctccgattcagcgttggattcggcgtccgagtttgattcagagtcggagccagaacttgaactagaacccgacccagattcggagccagattcagactcggagtcggagccttcttcgggctcggcctcagagtgttcttgttgatcctcggtgcattcttgttggtcctcagtatgttcttgctcctcggtgtattcttgttgttcctccgtctgttcatcatcatcaattgtgtcatgttcctcgttctgagattgatcatcctcgttggcctcagtttgagactcgtcttgtgttacctcctcttgtaacgactcttgtgaattttcctgttcaacctcatctacattagattccatctctacattggaatcaatctctacattagattccatctctacattggaatcaatctctacattagattccgcaccaccgtctacattattgattgcatccagttcgtcgacctgatccacatcactttgctcatttccattatcattacactcttcacctatatttacactcttatttacatcttcatttacatgcacatcttcatttacattatcatttaaatggtttgaatattcaggttgtgaatattcagggtttgaatattcaggcatcgattgatgagattcgtcctcttcatttaaacttgaactatttacactattgtttacatttgtacttttagttatactggcatcattagtcttgtttatatccttaattgtatccttatttgtaatagacttatttgtaacagccttacttgtagtatccttacttgtagtatccttacttgcagtattcttaacactagtacccttatccttacgtttaataccctgacagttgaacaagttaatactggcggcataggaatcggcctttatgtaaactataccattgtctacaccgttgcctctgggtccgtgtatttgagcactagtcagctttggaatgttcatcttttcatcgtgaaacaaatctggagttttgacattataatagtcgggctccttctctaccacctcatcctccaagtcgtccgaatctgccataaagtgtttgtacatcatgccatcatcaaagggtgtgcactctatgactatattctcaacagctgccggtttgttgggctttccatgaagcataaccctctttaggttgctgctgaaattgttgttattatcgctctgaatcaaatcctctgcgctagaggaacactgactatcgtaccggctagtgtccttcttgtgcacatcccttacgtgtcgcagcagattggaacggttagagattacctttcgacaatacttgcacgtagccttggcctttttcctgcgcggtttaatactgggcggtggcatcacctccacatcaacattgagttcactcttgatcaatttattgacagccccatcaaagtctacaatgggctccgctttgcgtttgcgatcacgcttacggtatctgtcgtgtttgcgctgttcgcgaatcttgtccagattcttggtgggtgcttgaattttacaagggttagcaagagtggtagtgggtggtggatgcacagagttgacattagtgccattacttttagaattacttttagcattacttttaacaccattgtaaatactaatactactattgttgttgttgctgttgttgttgctgttactgttagtattggcattagaaggcacactaggcacactaggcatactagacatagagactcgtcgacgtttaccgtaattgactggtggtgcgtagtcggcatcgtcagtatccgagtcttcaatgtggggtcgcttcgtcttaatcttgaggggtttaaggagtccgtttgttgttgttgttgaagttgaagttgcatttacagttgtagcaattgcatttgcagttgttgtcattggtactggcattggtattggtattgattttgatcttgatcttgcctttggtcttgattttgattttgttgttgttgttgtagcagccacatttctagcagcctcgatatcaccatgtgtagcagtagtagccgtagcaacagtatcatcatcatcagtagcagccgtagaagtgctcgtattggtaacgatactaacgttggttgtagaatcgcgcgaagagtcaaagctttgacgtctggcttcgcgctgatgtttcaaattctttagcctacgtttgaattcacgatagcttcggcactctcgattgagtcggcgacgttcctcggcctcatcgagaatgtattcgaccaggctaaactctttctgcaccggagagggtgcatcaaacgcatcggtagagtccattgtgtccgcgtagcacaccattgttttacactatttttttttgtgtacacctttgaaactaatagtacacctttgatgcacgaatcgaaaatcaagtcattaaactatagagttttcattgtttgtaaataaacacacacactgtccaagagagagagcacttgtcacattagcagagagggaggagctcaactgaatactcgcacaaacaggagcacacaaaccctacgccggaagttgaccataagaagctttgcgattgactgaagcgactaacctagtcatgaactaatttataatacaatataatctacaccactggtgataaggggtgtattatgaatcaatgcattgtagtttcataattgtggttaccataattatcgctaattacagtaatgcaccactttgttgttgcacgtacagaggaacttccgtgactaatctatgcatttcctatcatgcgtattgtggcaacccccttatctgccctttgttattgttgttgctagagccttacacgtgtatgaaatattttgattaccaatatactggtacctactagtactaacatctgttgataaaccatggcataatacaatcagtctatgttttcagtcaaaaaccataactaaactaaaatctgacatttatcgatcaaaagaacgcgcctaactgaaaccatgcgataagactgctccgtttatatacatgctgccctggctggtatggtttttttcatttctctcacactacaaagtcttttgatgtgtgtgcgtgtgttttgaaaactgtagcatagcgtttcaggccattctagtgctaaactgcattttactgtaaattgagtttctctcctctcttaaaggttcctagcactctgactcggacacttttacattacacaaagcgtttttataatagttacgaaacccaattaaaaatctagactatgggtggtagatgctgttggcagtttgaggatgcgctttgtgtacaactttgcaacttttcctttgattcttttaaaaactaattttaaaacatcctttgtctagcgtgtattaaataaaagcacaattataccggtggaaacaatttgatttccatgataagtctttacgatggcaacctgcatctttcccttatcggtgtccttgtttcctacaataccaagttttttgcaataaatataaagtgggcatcgtaaactttaagttttatgacatccagaagagtgagctgtacccagctatacatgtagctcacaaaaaaccacacaaaaaccataaacccagtctcgggacagagtttcgagaaaagctataaaacccgcaagaggttacgtcacacgccatcgataatttacgatacttttttgtattggatttttcaaggatctcagactgttgtaataaatgtcaacgcatcaaacctagatcccatgtgttttgcatattaccataaaagagcaccctactacatgtgcaagggattaggttgatgaaatttattgcaacttttacgatctgcaagtgcaccctcttttttccaagagtgtgtgtggttgccatttatgacaatcaacacaagtgatgatttctttaaaaaactaaattaaattaaaccctcatattctaattgcacctaattgcagttcctagtaatttattctaagcaatttattttacaacacactaccccattgcctactacctagtactactatacacaatacaccttttcatcctataaagaatgattaacaacaattgtatatacatgtatattataatagacacacaaagggtgctctgaatcctaaacttggaaactaaacctacttttaaacaatctcgtattcaacaatttcataaatctcatattccacaatttcatattcaacaatacaccaactgactgcgtccacttcagaatgcaacaaagttcgaggcatctaaaagaaacttgaaacttgcacaaaaagcgttgaactacaatactactgctcacatataacaacaatagcgtattgacgttatcgcggcacgcacatattagatggaagcgtgtgtgtttcgttgttgataaactttgtaggaatattgaacgtcgccttcgcgcgtacacggcgtttcagagattagctcgaatcgagtcgtatcaatcttggggaaaaagacgttgcactcgtaatactttttgatcgcagtcaagtgtatttggtgacaattgggatgggtcattgccgctgcgtacacggacgctcctccaattacccaggcggtctcaatgtcaccacgagactcgacgactctgatggcttcgtcaaagtttgacactcgcgtggctccatcgtagtcgcctcggtgcttggtggtcagcacaatgtttacccgaccgggtagcggcctgaatcgtttcggtatactctcccaagtcaatcggcccattatgactgcgttcttgttggggtgcgttgctgtcgtggtggtcttggtaaagtgtgccatttcacgtttcaagtgccagggcagtgcgttgttcataccgatgcccatgttgttttcacacacggccacgatgaggtttatcggaaccttgggcttcggtggatacgttatattgatggttagcatcttgggtgtgtttagcatcttgggtttgtttagctttagaggggaacctttaaagagtttaaagagtccaaagtttgacatttgtgggtgtctaaaaaatgggtacctaatgacaattgtacaactaggttgatgcaaaatatatacaaaatttatacaaactatatatacaacatgtacacaagagtacaagtacacactacaaatacccatgattctataattttacgattctataattttacaatacaacttttaatacttgctagttttaataaataccatgtataaatgcaactaatacaaccaaatctcgctgccgagtctacgtctacatctacctacatctacatacacatccacagctaccctctacaccccctctaactaacataattttcaaactttttataaaccatctttaacctctctataatctcactcaaattggtcaacctccggctaatgtcgtacgtcaacatctcgactatcaattctcgtaaatcttgatcaaagaccaccttcagagggtccgtgtgcatggtccagttgactttgcgagcatcctcacaattgtccgatatgcgaaacggtagggccccgttcgtaaaacagtaataagcagtcactccaaatgaccatatatctgaacggtaatcgtacgaagacgacaacttctcgggggacatgtatcgggatgtgcccattagagcggtgcagttttgtaccttgtaccgacacaggccaaagtcgcccagcttggcattcttgtagcgatcgatgaaaatgttttcaggcttaatgtcgttgtgcatacactttaatttggagtgcatgcactgaatcacttcggccacattgagcagcgccctcagcttggactggcaactcatcgatgtcacattgtgagtcaggtccttgttctccatatagctagagtagatgactagtttgtcctttttaaagtttacccggtacggtaccatgacccagggcgttagacgcttgagtttgtagggcacctcaatctctaccagtgtactgggattttttataatcttcatcacgtaaagtgtaccgtccaagtcttcgacgctgtacactttactgtttttgttgctctgcaacaggtgaatatatttgcgcattgtgcaccgatagctccttgtcaaagtttccgaccatctgatgatcaatagactattgcatctatcaggaaatttgcataatagtttagaggctatgtacaccgatcgtatacaaagtgtatcgcaatcatgtttgaggaacaggatcgcaccaagcaactctttgaagagtttataaagagtggcgtcgccgatcccgagacgttgaaaaacatttacaaggccaatcgcaactacatgagtcccgatgtagtggatgccgtcaccaccatcggtacgaagcgaacctttaccgtcggcgagtttgccaagtgtttttcaaaaatcatgacactgcccgcctttgagagctttgccaacagtacgcccggtgacgagcaatacgttcacctgcagagtatactgtgcgagtacctaaaggcggtcagtgcgtacaagaacaaaaactttgcccactttaagaatagcatctttttctggctccggagcaaagtggaacagcccatcaccaacactatgaatcccacaacgtgcagggtcaacgtaaagagttcgtacaagcccgaggagggtgcctacgttaccgtctttaacgatctagtgcgcaagtccaccgaacaggtaaacatgttggccaacgcaaacgtttaccagtttcaatatacgccgaggagtgcctcggtgcagatgctaccgcacagcactctgaacggtatcgtatcgaatctggtcaatttgcagacggtcatgaatcgcgaagccttggctcaaaatctcaagctgccaccctttctggacattgtgcccatgcgtaccgaggcgcccaccggaggcggtcccagtcgtttgaacatgtactaaccggcaatagggtaaacgtcttatgacctatatcgaatattgaatatgctcgttgtacgcgttaaaacgtataccagatgcagtcgccatgtctttttgtagaatagtcgattccaactacaagaagcggaatcgtttgattcactttaacctggccagtgtatttcaaaatttggtcatcaacgacaaagtgtgccaggggaaatgggacgagaccggtgccagatccattggttactcggtgctggtctactttgaaaacgtcgactacctgatccagcaaaacttgtacgtagactatgtgaacggcgaagagtttcccactagcgaagcgctcatctctcacattatcaagctgtacagaacctttaagcaatccatcgaacggcacgaatcggtggtggtgtgggatctggacgagacgctcatcaacgacgatggcacgctaacgtccgaggatctcatccactacctgttgcagttcaagaagcactttaaacgaatggtggtgtggtcgcacggagaccccggtcacgtaatcggacacttgaagcggttgcgactctattctctgtttgacattgtcattacgagatcgtaccacacatcgtacggcttcaacaagggcatcggttttgtactcaagcagctgaatcgaaagtttaaaactacaatgattacatactcgtgcctggtggacgacaagcccagcaactacataggcgactatacattctatttgcgactaaatcccaaagaacgtgatcattcgagagcgttcaagactgcgctaagcctgctaccggatcgcatagacttgtactttaatcatggatctaaaatgtttggaaatttaaagtacttgtaaagatccaagggatttgatgtttgaagggaggtagtgggttgttgtgcttttgttgtacttttattataatgtatcaatttgttttaaagtcctagtttatcaaagtagtctgaacatcctagtttacagtaaagtcttaaagtccgcctatgttgttgctattgcttgttatttgttgtttaaatatttgtaagagtattaggataagagtgtgtagagtagagtgtgccgagtgccgtagtgtgtagaatggagcatgtactggatcatgtagagtgccggagtgtagagtgtagagtgtagtagctggtggtagagctacatagagctataattggcagttgtactaattgtaaggatgattggtattgtaagaattggtattgtaagaattggtattatataatgatgattggtattgtaaagagaattggtaatgtaagaatatttagttttagtttatattacaagattacaagattacaagaattggtaaacctctatgatgggttgtagtaggtactagttgtactagttgtactagttgtattagtagtagtggtactagttgtagcactagtagtgttactagtactcgtatacgacaagttgtgtataaaatgaacaacgcttgcagtattcttttttaatagagctactctgtacaaactcaaatttgcatcacacattgttgcagttgaaaataaccttttatttacaaaacttgatattgtcataaaagtctcataagttgaactcctcattaaaatttgcatattaacctgcacgttattgctatttgcatattaatcttgcttgttaattttattgtacaaaaagtttaaattccttcaaaaggaagagagagttgcacgttccccatagtattactaggtacttgaatctttgtacttatcgagtacttaataaatattaggtataaatctttgtataaatatcacgtttgcgtgtatgtatatgctaggttaatgaatccatacaatcaacaatgtctaatgtacctaataaccttaatcctaatcctaccactaccaccacaacctacacccaactagacattgcaaatgcctccaagttttcgtaccatcgtaaactcttgatgctactgcacaagctcaacgaaaagtatccattcttggcgtcgcacttgaaagtcaacgtcagagcggccaccgatgccgattattacattccaccggcaatggcctccgaggccatattcgtagaggcagagattacaaaacaattgtgcgagagcatttcgtgcaactcgtccggtgtgcacggaccctgcaaaaagacggatgcggccagctactatagattgggcgagagtgaaaactttgaggttcaatgcaatccggcctgcttccacttgttcgaaacggccgtgcacaccgatgacggtaccgacaagccacacaacgttcgctaccgttggtcagagactagcaacacttgcaatatcgtaccttttgcagccacctggatggagattccccggtatcggtccagtgaactgtacgcgcctaggctaaacgatctcgacaccggctttgactatgagccgtccacggacacgtatcactttaacaaatactattgcgacgtttactacgaagcgttcgatcccgacactcgtacctgctacactaaatggtataataaattggccaacataatagtgggcgatgccgtaatcaagctgataaatgccggtctgaccgccatgtcgaacggtaacggcaaaactttaccgcctctcgaaaaggatccacctccggccatagacgacaaatggacagtgtcgggctggcgtaaaaacgtcgatcccaattttaaactaccgcccatagatgtgaccgtgagcgatttggaaacaatgaaccgagtgaatcacagaagcaagaggagtcccaacactataccaatgtctgacaatgttaaaattgtacgatttgatgatgctatgatgaaatctaaaccaaagcctaccaagcctagtactagtactaccaaaaatcaagacattgaaaaactcttaaatctagtcaagagtctcaacgatacatcgggtgcggatcgtgacctcaaaaatgccctagcctcacagactggcaaacagaccaagtttgaatcgatcatactgtcgctgctcaacgaactgaccagcgcagattttgccgccagcgttgctgtagacgtgggtgtcactcaactggccagtcaactaaagacgatgacggtgaaggcgattcaaaaactggtgccgttgctacaaaagaaggtcgccacgttggccatcgacacctcggaactagtgttgggtgcatcgttcaaagtggccgtacgagacttggtggtaccgttgacggtgcgcagtctgggcacgatcggcgtctacctgaccaagagtctggccatggcctcgaccggtgtgggtgtagtcttgctgataacgcaactctttagcatactgctcacgttctgggatccgttgggtttcaacaacatgtacacgcccgactacctgcaccagctgtacgaaaactcaaagatggcgttgcgctctcagctcaagaccaatcgaccggtgctgacgttcgactacgtgtgctcgttcctattgaccgaggaggatttgttcgatgccagcatagaatcgtacacatacacgtatcgctacttggacgccctagaagtcaactcggacggagctcgaatcaacaagggcaacgtgatcgatgtgggctcgatagagtttgaaaagattctaacgcgagccaaactgtttacggtgcaagactttgaagtgtacgagtctcatcacaagctacgcagacaggcctttgacactataaatcggtacacgggcatcgctgtcggtatcggtgtcgtgttgatagttttacgagtctacctgctcggagtcttgatgctcctgctgagcgttgcactagtcagtgtatcgtacgccaacattgcctttaatgtgtggcagtggataacggaccggattaatcccttcaaagtgtaacatttattactacattttctccacaacatggtataaaactggtgcagctttaccgcaatatggtatttgtacttggaccgttgcactattcacagaggctactagtattacctaaagctttaataaatatatataggctacttccactgctaataataacatagaggcttgcaagataccaatacttgtattgcatcttgtattgtataccttgtattgtataccttgtactacataccttgtacctacagattgtaaacttccaactatctcttgtacactatgaatcgctcaaacaacaacctgttgagtgcactgatgggactcttcaagagacccatagcggccgtgtccaatctggtgcgtagccgcagtagctattcgtttgaacacgatcccatatgcgtagagggattcgatgaatgcggcactaggccgatgcacgagctggcacaacagcaccgcctaaaggagctcaatcggcaagaggccgaactgcaagagttgcaattgcaaaaggaggccgagttgcaagacgccaaacttagaatgattgacgaagagatccgacgagagtttggcgtcgaagatattcaagagtttgagagacgctttgccgaacagttgatggccgacttgaagcgtgtcgaggaacgctacatggccaagtgcaagattaggcccactaagcgcaagagcgtagaaccggcaacaacaccaacaacaaccggtggcatctcgaatcgttgcctgcgtcgcgtaaacaaactctttaaccgagactataccgaagaggctgcctatcgtaaactgtctagtagtagtgccaatgatggaatcgtcaagtctaacagtgtagatggtggttgtgttgatagccgtagtcctacacctccgccgccacctactaccacccctacaggacaagacatggtggatgtcatcctaccgcctgcaagtgcacccaccagcataagcaacccaaagaatgattaccgtgccaagctgcgttctagttcaagactgcgtcgtcgtcgtttgtgcagttcgtgttcgagcatcacttccgagtctacgcagagttcgttggcttccgactctgactatggttcagaagttagtctgtttagggctggtgttggtatgaattcagaataaatgtatcctacaatttactatcctacaatttacttggcagttgtttgtaaccaccatgtgtattgccattagatttaagtagtgtacctgtatttatacacatgtgtattgtatatcaaatatttagagtactattttagaatatcttggagtatcttgtagtatcttaaagtacatgtaaaggttttatattaataaataaaaggctcattttttagacacacacaagtgtttttattttttagaaatatacttcaaatacacatacaatacatcaccccatcaaccccatcaaccactctagttttttagattccccaacatggccaacgacgacgaagattcaacactggcgctgtacaaggagcgtacaccaaagcgcttggagggcacgtacagagtttgcatctacgcgtgcatggatccggaacggttgacttccgaggttcgagtctctgccgccaaaatgctctggtatgtggtgcatctgattcccaccgacttgtacaatctggtggtgtgtgactacaaacgagactttttcgatatgctcagtgtactgttgaagcgacccaagattgatggtgacaaggtgtccgagtactttgtgcgcatcaagcaggatgcagacactgctgccgagttttacaagtttgtcatcgaccactatggcctgtatccggttgatattgagaagctcaaagagtggtggggtcacacgtattggcgctttctgcacctgaccagtattctggctcagaacgacaaagagctcctggtggcctttgcgagcattctcatcaatctcagtctgattctagtgtgcggcatgtgtcaggaaaactatgacaaactagagcccatcatggcaatcacctatcctatgctactgactagcgatccagttactcgaatctatgacctgcacaacaaggtgaacttgcacaagattcacccaaccaaagagtttgcatttgacgactttttgagactctacaacctacgcgtactgtctgagcaacatcagagtttgagtgcaattgtgcaggtgccctagggtggctaatggcgagttgttggttttggtagtaagcttgagtgttggatggtattggtttgttattttattagagtaggtggatagatggatagttgtacctatgtttagctttgtattgcaagtttacattattttataccattgtacattcttgttttttgagaatgtaaaatggtgtataggtataacctctttaccaaaccaaaccagttaccaaaccaaaacctttaccgcacctcctatgctagctacacagactggcatctactggtatctatactaggcctctactctgtctactttgggtttaactatactctgaattctaactctatactctgagttctagcactactctgagttctagcaactcttttatagtaactaaaggcaccactccaacactctctgggataccacagtagaggttgcgtgcaccgtttagtttggtgagactcggtgctcggagctcggtgctcggtgcttgtagtttgtagcttgtagatgtagtaggcaggcaggatgcgtgtgcgtagcttgtagatgcagatgcagacacggagcgcagggtaactcggagtgcagtgtagactcggtgctcggtgcagggcaggatacttgtagaataccaatactcttcagaataccaatactcttcaaaaagtaactctatactcaatcacaactctataatagtctcaaaccctagtggtaactctggttttatgtatttgtatatttgtatgtttgtatcaaacctaacacacaacaacagcctacagtacagtctacctaactgtaacaaaacactctacctaataaaacactctacctaacagcagttcgtgtaaaggttgtatcaggatgcaggatgtataaaatgaaacaacaaatgtcaccagtaattgttagtttattgggtggtgaaaaaaaaagaaaaaaaccgttttaatattaaaatactgactctacgttaacgttaattggcaagagcgtgcacgttttttgtgtgttaacgacaatgtacatcggagataccaggcagcgttatcgtagccgattactgcgaggcaatcgatcgcatatgtccacaactcaaacacttgcacgccacggttgcaacaaggcactaaggcaatctctttgcaaagcaaacaagcgcacacgccacgagagactgcctgaaagacaacgtgacggtgcgagggggttggtcagtgggttgttgtgcaatgcgatactcgtacacagagcctaacgatcgcatcgcacgcctaggtgtgcaagacttttgctgcattctaatctacacgaattgtgcaagaattgaatacaacaaactctttcaatacgataccatttagagtatggttagtgaactcttgtatggggatgggttggttattattgggatatgaggcacggagagcataacatgcaccactagctttggtgttgcatgcgatacaaaccatgccaaaggtttgactctacgccctcttaaacggtaccgaaccgaaacgctcatagtatcaaattctgcactagacaccctacgtactgtgcatttactacgtgtgcttaacttatgtgtgtgcatttgcctaaacctattgtttgataccttttgtttaatacctttgtttaatacctttgtgtaatacctttgataccgttatttgataccaatacctttgtttgaaaccgttgatacctttattaaccaataccaataccaccagagttaccaagagacgccagagtcagagtcaccgagttaccagatttgttgttgtagttgtatatgtacaaaagtaccagagtatatcagagtacagagttctaccagagtatttaccagagtatagctttatcagagtaccagagtacacaaagtttgccgagtataccagagtatagtagttgcagagtaccgtacctagttgtatccttgcatttatataccagtatatgccagtcttaccaccagtctttaccagagacactttgtcattatcctaaatgtcctaaattatcgtaaccctaaattggtgtgtatagtgtgtatgtgtaaatgtgtacaacccgtgtttttattttatatgttttttttatattgtttgcaatagtaggaagtaggaagaagaagacgtatactacacaaatcaactcttgtttaccgtcgtgtatcaatttataattcaattcataaagtatcacatcttactacatctattgatttgtgctcacaccgacttatacactagccgcacttaaatctaaccggacttataaactagccgcaccgacttatagctaaccgaaccttatatctaaccgagcctaccttataactaaccgagccttataaactagccgtaccgcttacagactaaccgagcctaaaactaaccgacctaagctgccgagactgcaacagacccaacgaccctaaccgattgtgttttgttgttgtgagcacaaatccatgtgtgtatgtatagatttaaaaatgtttggtaggtacccatagtagatagtggtagtaatagtagaaggatagaatgatagaatgtatggtattggttttccgtttgttttaatgtacttttgttttgtttggtttggtttgtaaaatgtgtgtcagtgtcagtgtgtatgtgtaagcatgtgtaaaaccctacctacctagattcccacagatggtcataaattatctcataaattatccacacaatatcaacaagtataaaatatcaatcagtgtcaagtaatgaaccataaaatgtaaaagcataaaataaaaagtattgcaacacatacctatgattatactcggcacactattgttcccagcacctctactaaacgctatcctctagtagtagtactgttctacatataagtgttccatcaagtctcttgtaaatgcacagtaaaaacaaacatcttgcactcaaaaacactacactaacaaaactaaaagtccctatggtggcacatgtgcaagctacgcctacctaataataataaaacagcacacacgcacacgtgtatttatagatgcccgacacgcacacattaccattgttattatcctcaaatgcacatgtgtgtatataataaaaacatcctacctagtacatgccgggccagataagactaatgtagaataataacattattcataaacgagagagagaacctacagtttatacactgtgccaccaagagtttaagtctcgacactgcattaccgttgccgatactacagtgccaaaacgggtaccagtatgattcgagtcgaggtggcatctgaataaaatccattcaaagagtccaccctgcgtattcaacgttaagcgacagcccgagtcatctatgctacctactccctaaaaagtctaagtctcgacacctgcacgcgaatttagcatccactcgtgcgacacaatcgaaccaaaggaacccgtttgcataggagcagtggcttgtgaccaacaaggtcgcatgtcgcctttaaggaacacattcggacaacatgtctcgaacacagagcggatcagatgcgagttgtgtttggttttggcaaagagcagtgctatcgtttcgtaccagaccgaggtccgattcgggtcgattactccgctccataaaatttaagtatgctaagagctataaaaagtgtatcagatgacccgagactgcacattttaaaattgaataaacagagcagacaaattaaatgaattaaataagaatgagccactcacctagtaccagacgctgcctacaccagtgcggtatgaacacgactcgaatcagactgatggtgttcgtcaccagtctcggctttttatagtgcggatggcccccactctgttgcgataagaaccgagcgacgccattggtcgatgagtaataaaactttatcagaaaaacgtgcacacctactagattcttctgcggggggaacgattcctcttaatgattcttctacatgattattcttttttacatttttggactccttttcacaagaccatctgtgggatacctcacatgtggtgtctctgtactctggtttgtcctaaaagtgtacatttgtatactttttatcatttttaccgctagctctttaaattttacacttttgatgcatccaatgcatctgtcccgtctctggcgttgtctagtctatagccagtcattggacggctcgctacaacattaaatactacccttttataacaataattaaacgcctacaattataccggtcccgagggtctgttgcgacctaaaggtctagtttctagattccaataccgttattctaaccgtgtgaatgaattttgaatgtatcttcaacgtataaagctataaacaaacgcttaaattaacatgcataataaattaacacaacaagatggcgacgtgccacacccagttcattgtttacaatcgaggttataccaattcagatgcaaatcaagacatttgactgatgctaaaatgtagccagacactttaaactacactcttgcgcatagccgggactctgcgcgaggggtaactgtgtcaattttcaattttgcatacaacgttttataacctcaaatgtagacgattatgtatatagagattgttcaatactaaattatttaatactaaattacaattgtttaatatttaattacaagtatagtccgtgtttattttaaaagtagacgtgatgaaaacttaggtctacgaggggtgatgttgatgttgagagaggatgaatagaataatttgaatatggatgtagagagatgatttgaatgtgaatgtataaagatgatttgaatgagtaaagtctggaaagatgatgtctgaaagtctggcaccatagtctggtaccgtcgagtcaagtcaaagagtcagttgttgttggatttagtcagtcaaatgatgcgtctcagtctacccattcaggctacccattcagcctaccctttagagtccccatacgattcccatagtagcatatgccgagtccctttatagatagaatattcaacgtttataaccgagatccgttatagatggaaacaacgtttgtaaccgataccgattgagaccgttcttctttcttgaatccagagtgtattcagagtttcttattctacagacagatacaaatatagacatacaaatacagacatgtattactacagtagatgttcaatagacattcttagtccaagtattcttagtctaagttctaattaattccaacattatacatttatacattcgtcccttgtattcatctcaaaatggtaacattcatctcaaattggtaacatcagaacacgctagacgggctccacattccgaacccaaactggttccacataccggtttatacgtacacacattccaactttaacaaacacatcaagtttaaacaggtttaggaacccaaaagcattgttaaatgtaaaattcaaaagcatgcaaatacctgtaacggcaacctgtacgattgcacaagtttgccgtgcactttatataggtgcacttgttgttgttgttgatggtttgatggtttgatggagagcgactgcatctgaaacacacaagggttagctttggagttttgctgcatcacatctgaaacatttaacattaagacatgtttttgcattatgatttgagtacccttgtattctagcattatcattattcttacaaactagatttgaccatttatacaaaccatactagagagatggatgtactacaaaccagttgcatactataccaaaccatccaaaccaatccagatgttgtatgaatacatcaaccattggaatattggatgccataggtagactgtagaatggagcctctatgtagacctctgtgtaggcatctgtgtagacatttactgtgactctgcaacatttaaattgttagacacttggggttagtagtagaggttagtattagaggttagtattagatgttagtagcaagtagtattcaaaggtagtagtcaaaaaaaaagagtgtgcacaaaccaaacacactgatgttttgtgtaatgaatgttttgtgtaatgaatgtatgattttgtgtaatgaatgtatgattttgtgtaatgaatgtcttgtgtaatgaatgtcttgtgtaatgcatgttttgtgtaaatgaatgtatgaatttgtgtacaatgaattgtgtaatgattgtgatgatttgtaaagtgtagtgtaatgcattgtgcttatattgaaccaatacagttcaatctcaaatctagaatcaaaggactcttgatttggtgtgtagacttacaactagaaataaaactataatgtgtattcattcttaaaagctaatacgtgtacttaaaactaggccgtattcttaaaactaacacgtgtacttaaaactagaccgtattcttaaagactagacgcatccttaaaactattcaattcttaaaatctaaaacgcatcttaaaactagaaaccgcaaatcatcttacatctaaacgttgcagtcaacttatagctaggcaccgtaaaattcataccaatcatctttagtcgtaccaatcctcagtcataccaatcttctttagtcataccaatcatctttagtcataccaatcattctcaaatatactcgtcagtctcaaacatgccaatcactctcaaacatatacattttgtaaacatagtttcatcatttaacaatacttaaaactatacattaggtagttgcaacaaacaccaatcgttatcttgaacaatgcttgtgcctagacattccaatccaaagtagcaccaccacagcatcaatttccatggcaacagcgcatatcacgtttctagacacccgacgacagcacttggtaaccaatatgcttcctagaatatggccattaaaacgaaaacaatagccttgtttatgccacacagtggattgtttattcaggtgtgcgatatcaggtattcttatctcgaatggcctagatgaaggggtgttttttcttcatttcctatttttcaattctttagtaaacttccacagcgaatgatgcacatttcaagtgattgcttgtactgcattgtaggcacgttcaaatccttgtagagtttaatcctttagaatccaatcatgtagaatcccacttctgacaagatgacttccgagaacctataaaaggtttaatcaaatttaaacaacacgggacaataggatgggaaacagtaaaacacttgttgttgttgttggtgttgtagtaaactctttattgaacctaaaagtgctctaaacctttatacgtaccaaatcaccaagtatggtagctgtccaatatccgtgctcaatttacatcactttgcgtcaattacagcacctgcaatattgaaaccaaattacattagctgttatattacaagtctaggttgtatactcacagagtgctccttgtagctgcaaattgagtatgctgtaccttggacgaggggttgtcctctgcgcctgaaacagtacaatagcattacacttggatggttggttgctttggtttttcagtaggctgttttatacttttgtttgtattacaattcttatagtttaaaacagaattcttatagtttaaaacagaatttcttatagtttaaaacagaattcttatagtttaaaacagaattcttatagtttaaaacagaatacatgtataaattcatttgaatactttacaaatgaaggattctgaaacaaagagacttttgattagtgcatctgaaacaaagagacttgttattagttctcgaatctgaaacatataaaagtttgattaaacctgaaagagagaatgcattgattagtggtacacatggttatagacatatagacacatggacacatatacacacattatttcaaacagttgtacaaaacatttaaactacaagtatgcatacctgatagataccaatacttaccaatacatgatacttaccaatgcataatacttaccaacacatgatacttaccaagttgacattgtacaatacttaccaaatcaacactcaccattacttaccaatacttaccaaaccaacaattaccaacacttaccattacttaccaatccaacacttgccattacttaccaaccctcgtcaggttaaggtagagcatataggtgcagttgtctgctcagtctcctgaaacacatttaattgcaatcttagtacattctacccatcagaatatttcaacaatcaaacgatacacaccttgtataattgttatatgtataatttttaaatgttttacaacaaaccatcttaccatcttaccatacatcctcccatactttaccaaatccaaaatccaaaatccaagcatcctcagagtaaaccatccaaggtgtcctcagctcaaaacatccttcaccgcaccaatacaccagtctctgtgcaagttttgaccgatgccgctagatggttctgtaagcacacaaattaagtgtacagaaagattcccaaccaaagcactgctgcacgtatttataaagcgattcaatctatgcatataaagagattccaagagccaacattgttaatgttaatggtttgcgattataatcagtaaatgaggtttaatgatggtctataaagcggctaggaataatgtttatcaatcaagctaaatgaggttttagattgagctttagaatgaggtttagtgtataactgccaattaatgtttcaatcatttacttgccaagttatggcttattagatggacacgcttaatgatgtaaatgttggttaatgatgtaaatattggccatgttgatggttggttgttaatcatggttaaatgtttatgtttatgatgaatgttctttgatagcaggcttggtgttattatagcaatttatcccattatagcaatttacccgtcaacaagcaatatgtgtctgtaaatgcatacattactctagatacttactacacgaaatgtgcatgtataaatgctaccgctaaaagagccaagaccattagtgtctgtttaatgtcaatttagttttaccgtcagttggttttaccatcagtttactccaagtatcccactttactgcctggttaatttaatgccagtttaaacttttagtagcaaattatttttaaacgcccaagctggtttaatctaggcatctttaccgtcagccttgttcaactctggaaagctatcaaatacttcaagtgccaatttagaatctcttggcttgtaaagttgtataatagatgcccacttccgtgcattacattactaggtggtccagtttatggcagtataacttttgttattaatatacacactcccagtttatgcatttaatttttcacaggctttttaattttcacataccattttatagcctctataaaactataattctaaattatagaggcgctcttccagtaaacttgacaaatgcataaatttcacaaacctgattaacgctactctaaatttatgcacatcaggtggtgttattctttttaagtatatccttcttttatactataaattatattcacatctagtatgctattctttaaactagccaatcctctaggttcaaacattcttccatacaatgccatcaaccgagtacctagccccggcctttgatcaaactattgaaggtggcagagatttgtgatcttatgccaacttgcaagagccgccctggttgcagagtgcaacctgagagatgcatttaagatgcatttatttgttataatcatttatcatttactctgacgcttcagtatacttgacaaactgtacattcattcaaaacacttgttcacactttatatttcacacttcactgtatatttcacacttcactgtatatttcacacttcactgcactgtttcactgtttagaattattttagaattattttagattttagaatatattaaaattccaaagtttaaatcaaaagttacatcaaagtacactgactcgaatatgcaaacactgaatcgaaattgtctttaatatataaacactttacactcaataataataatcacacacacgcactgtccacttgtatatttcacacttcacttgaatgtcaacacggtaggtactctaaatttaggtaggtattccaaatgtccaagtcaaatgttagtttaagcaatagatacacacacattttatttagtacagtgtgcaaagcatagagaagcaagtgtatagaaaagaagccaaatagatacaatacttgaatactacaagggtcgtactacatgcaagaagtgatgtcgatcaactacctactcactcatcgcattgtatcgttaccggcacatcaactcttgtagattgagacattgcacagaatgcgcttcaacctatagatttgcatcattacaaaatttatacaaccccctctatgtctctatatgcaagtgtccaattagcatagtccaatcagtccaactttacgagcattcattcaagaccccatttaaatcaagactagctagccaaatttaaatcaagtctaatttataccggtttaaaccagtctcaacttttcagtaccccttaaatcaaacaattggattctacggttaaagattttacagttgttaaagttgagttatagtcttgtggatgatgcctttaaaatatcccagcaacctttaagtgccccagtaacctttcaataattttaaatggtatgtacaactcttgttagtaagtattggtaatgtgtaaattattaaatagtattataacttgttaaatattatgcaaattattaaatagtagccagtttaatatatagttttaatatgcagcattatatagtatacacaatagaagtcaactgttacaagagtaggtagagcgcaaagcaaaatattggactcgtattacacagttttataaagattagtcacgccgccgagcttacaatgcaggttcaagttcaactcccgagttcaagtttgaatcaaagagcccatttagttataccgagccacaccgagtctaaatgatccagtttaaacaatttgaatcaaagcccgaatccttgaccgagtctcggtttaagtttaaacgaacgagttcaagtttggtttagtttgatttggaaacaacgagtcccgagtctctataccaaaagagttaagagtttaagattacaagttttaagattttttaacgaagagcacacgagtcccaccgagtcacactaaacgattccaaaagagtttacgagtacacgagtcccactaaacgattccatatagtttaagagtacacgagtccaccgagtcacactaaacgattccgagtcacactaaacgattccaaaagagttcgcgagtccaccgagtttacaattacacgagtccatcgagtttacaattacacgagtccatcgagtttacaattacacgagtccaccgagtctaagattgcacgagtccaccaaaagattccccaccgattctatcaaaagagccccaccgagtttacatagagttcacgagtcccaaagagtcccaaagattccaccgagtctttacatttattttaaacaacgattccccaccgagtttacccaaagagtccaactaaaagagtccccatcaagttacgattcacaccgagttaaagagtccccaccgagttacagattcacaccgagttaaagattccccacaaatgtaacaattcacaccgagttaaagattccccacaaatgtaacgattccccacaacgattcacaccgagttaccgagtattccgagtccccacacatgtacgagtcaaaacacaatcaaagagtccatcaaatacaaatcaaaacaacaagtgattcaaaagagtactcatctgtgactcctggggctccctctgaggctctgggttggtcctttggctgcttgttcctggtccgggtgtgtaaagtagactgaactgaccagaaaatttgtctctttatatactgtttcagacaaaggaattttgaaaatcaaatcttatcaaaatggaaaactaccaaggtcaattcaggatgtacgtgcctatgagcacgtagccagaattgtcacaaatccaaagcttccgaatccctcatttctatgtaagaactcatgcctttaatatcaatacggtattggggttattgtttattgaaattatatataaatgcacactcggaatggatcacgattcgctgtatttagagtttataaacaagacgatcggtccgtacggagttgcgctgcatagctactttgtgggaatcgtcggaatcatgactgttattgttattatgatttcgtgtttaactcaacgatccgtgagatgcaagcgtacgattcccaaggaccgaaaggtttatgttacgtctgggaactcggtctattgatgcttgtgtttttttagagatttttcaagatgaaggtcatttcgatgaacgattacgatatactcgtacaggttgaccgagtctacgatcccaaactcgtgtgcgaagaggtggattctcttgtagacttggactcggcaaccaaggccaacgataatatcgttgtcgacaccaatggaatcgaaacgtgtttagcagagtccgagttcaaggctgagcaaaacaatgaaaacaaagactcggagtcgccgcttgtgaatattgacattttaaaactcattctaccaaagagtctaacaatgtggctctttaccaacaagactaaatggtacagtatagactcgtacaagtttggagagttgaccgtcaccgaggactcgctcatcgacatgattcacaatcgtgaaattgtagcgtttgcctatgcaatctataggactcacgaggacgagcaaggagtctggtccgacatcaaagactcgattcgtatcatttttggagtcgttgaactcgtaccaaactcgatgagttcatggttgcgcactcggtacttgcccatcaatgagattgaatcgcccaaggtgtatcctgatgctccaccatttgtgctgcaatcgatgcatcgtccgcgcatctggttgaccgcatacgaaaacgtaaagtgctccgagtgcgggaatcgcatgtactcgctcaagggacctggggagccatcgttttgctgtctagactcggagtgtgaacaattcaaaatgtgcaccgtatcgttggagtgcatcgatttcgaaactggcccactcaacgatttgaagaaatccatcaagactcgttcgaggtactgtaccgaggacgtgttggactcggtgaatcagtacaatcgttcggtggcgatgctgttgcacggtagcaaaaaactaaagcctggcaagatttcaagtggactcggtaaatcaaaagtggactcttcatccgactcggtcatcaattgtataaagtgtaaaaactgtaaagtgtgtcaacgcatgcttcagaccaaacagactcgatgcgctaggcatccagtgtgtactcatttcatgctgaagaggaggctcatgtagagtgagaaaaatgttatgtttagtgtaggtaggtagagtatgttacttgtatgtatttaaatgtttaagaaataaataaatgcaacttttagttttttagactcttgaatctttattcaaaaaattaaactttaaattaaaacatacaatcaaacacactaggtgtacacctcacgtaatcctaggagcatttacaaacgtttcgatatagttttgatcaatgacaatcttgcctccaaagtcgatggcaaagtttttcaagtgcttgaaatcgtacacttctttgcagtttgagatgctcatgaaaattataaacttttgacaatcgtaattaaactcgttgactacatcgttcaagtgtggcatcgcattaaacggacacctagacttggagtctgagtccacctctgtctctatttgaacattgtcctgttgttgattctctacatccataacgtctgtttggaaatctggccgagtctctgtttgaggttctgattgagactctgtcttggtatcctttgccttttttggcacctgactagatcccaagtaatagtgtccattgttgttgcttatactgctattgccgccaccaccgcatccgctcatcattgaactgtgaccgccgttggccagtttccatgtgccggtagcgatgagctccttgtagtcgtgcacgttttctctaaacagaatcagtctgcttccaaagtctcggtagtaccacagcttcatgtcgttgcacagtggatcgtatttgctctcaatgttcaaactatagcactcgctctggttgggtgcaaaggtgtaaaacaccgacagatagggtcgggcatcgttgtacgtctcggacactccgtccagtttgctaatgaccaacggtaccgcaccgctgtactcggaactcgtaaacattgtaaagtgcttgagcggggatcgtggaaaatcattgcacagtatctgctcatagtgcttgtcgctcaggctcattcctatggtgtgaatgtagacatttttgtaatgagtcgaattatccagtagcatgttgtagtctctggatacgagctccttgagccgtttacgttccatattcaagagaaacgacattgttagttttgtagattttgtcggtatagcgtattggtgctgaatcgataccggtatactttaatgggactcggtgaatcctgcaacaatatgattagcattttcagtgttataagttttataatttatacaacactgtgcatgtgcgttgcggtactagtgtggaagcctcagttggtggccaacattatcatacgcaactatccatcgcaattgtacagcgatgcatcagacgccgagtatgtcgagcacgagtaccgagactctaaagtgtacacgtacaacgacactggctacgaaccgggttcaccggtaatcatctatctgaacggtggcatgtttgtaatgatgtcgcccgagctgagagccctccaagagtttacccaccgacgcagactggtaacgtttacacaccctgtgcgattcgatgccgaaactcgagacattgtcgagtacattagagacttgattgtcaactacattccaacgctctacgcaaaggatccacccaaagagtactttatagtggcacactcggcaggtgccttttacgccatcctcatgattagactcatcaacggcagcactaaacatgatagtagcaacatgtacattagtcgattcattggtatcaatggattctacggtagcagcacaaccaagtttctaatgttcaaactcttgtcggttggttatgttgaaaaggatctacctacaccggtacccttgtccatagcgagctacacggatcgtatacacgtactcacaaacactgacgatttcatccgagactctagtgaggcgtttgcgcacaacaatggtgcatcgttgcgagtgatgcccggagatcacacttcactctacacactgtccaaacctgaatcggtcaaaatgtttgagtatttgaacgagttgattttggagagttgaagttgctgttgtgtttgcgggcaatgtaggtacctaccgaatgaccgagtgttgtgtattaacggttgtgcacctttgttgagatttatataccaaggatgtaatattgtagaggataaaaaaatgtggtattattttactttgatttactttgaataataatgaataatacttggtattgtagtataaatatatatttaattatttatattttttaataaaaaataagttgtattacaaacattatccttgtagtcattcttaccaattgtgcttaaaagccatcttttagatgctcttacaattcatcttttagatactccttttagatactcgtacaattcatcttttaggtactccttttagatactcgtacaattcatcttttagatactcttacaactactataaatactctcaagatttcataccatgtgatggtgactctatagactaaattctagattttaaaactctacaaactatactctaattttaaactagatgaacactggcaatactggtatacaaaatatatagatgtaaccaacacttgttatattaaaatgtacaacatctctctacaacattaaagtacaaacattaaagtacacttagacattaaagtacacttagacattaaagtacacttagacattaaagtacatttgaaactttaaagtacacttagacattaaagtacacaaacataaagtacttatacaaacattaactactcttcactttaaaacactcattatcgctctctctcttaaataaagtgtatcggaaccagtgttgaaacgctcatatccttgggtggttccacgctaggctttgggaacttggccagcgtacccttggacagcctatctagtgtggcataatctttggcgtacactttggcaaaggattctgatgtatcacttctagacttgttgagcatgtcgtccacatcggggccttcgaaaccctccgattgactgattagcgttattatgccggctttgatgaattcatcactctcgcggtactgttgcaagagtgcagaaattcgttcattgtttcgatacgctcgacggtcatcttcgtacgactcgttaatgtcatcattgagtatagactcgtactcttcgagcgtggttattatgctatctaaagcatgctcctttatcgtggcttgcacagcacccaggaatcgattcaccaccgcctgtatgttatccttaatcttggtgttgagtaggtagttggtgtatctaccctgcttcttaaacagttgcttaaacatggatctaacctgtttgaatttgttcagttgaacagggtcgaagccatcaccgctgggatcaaacagttggtagttgttgttgttgtacagattgacgataaagttgttgcgcgcattcagtgtcacacctcgtatgatgcgcggcaacagaggcggtgccttctttggtggtgtcgcctcgtccggtgagggatcgttgagtttgcgtttttgtcgtttggccttgtgcacaatgggcgtctttggtggagacatgctagtgtcgctggcactgctagtgttgctggcgctgctgttgtcagtagccttattggcatcagtttcaacaacagtattggtaggaggtgtactcttaacaggagttgtactcttgtttggagttgcactcttggtaggtgttgtaatcttattagtaggtggtggtgtactcttaacaggagttgtgctcttagtaggtggcggtgtactcttatttggagttgcactcttagcaggagttgcactcttagcaggagttgcactcttagtaggtggtggtgtactcttaaccggcggttcactcttggtagtagttgtgctcttgataggtggtgcactcgtggtaggtgttgtaaccgtattaggaggcgtaatggcagcagtactaccactagtagtgttgctggtactgggcttggacgagtcttcatcgtcactgtcatcactcgactcgacaaactctggcgtcaggtagcgtttctgtctgggcgatttcatggccgttatccttcgtcgtttcgttggtgttttggtttcagttttaatttgctgcaccgtctgttggaccgtttcttgcatgatttgatcgtcgtcagtctgtacagtttgctgagtggtctcctcttgtacggtgtgcatctgtttggtggcacccttttgtttgacagccttcacctgctgcttgacactcttcatggctctggttttggctttggtgacgcccttggttttcaccaccggtgtactgctctgcatgattgctttaacgtttgacggttcgtacaagtcggtgcttacagtttgcttgacaatggatgtatcgttgctaacaatggatgtattggtgctagtattattgttattgttagcattcttaaacaaatttacatttccattgttgttaatgtttttactaaacgcgaccaatctctcggggggcaaaggaatactgaccggtagtctcattggtacaggggtcttttgttgaggctcggcttcaatcattggttctggttccattacaatgtttatgctcgtatcaagttcagactcgctctttattaacgattcgtttggtgtagacgatctactcggacgcatgtcaacgtctgtattgcgtatcggtgtgattgtagtgtcggcaaattgcaccatttgttggataggtgtaccgggcatcactttgatcggttgcaccaccttactttgactctttctaggttttcgtacacgtttgggtgtaggcttgggcgctggctctggctctggctctggcctcccaaagtcgatgctctggttttgcatcctgatctgagtctgtatgtctgcatcttgcaccatgcgtctgtttagagcttcaaccatttcgacattggtttgatcaaaaacattagaattgaaagcatctggatttacagtgttgacatttgcattgttaaagtttacatccatcggtacgattggtgcttgtaggtttgattgaacactctgattcattagaaatctatcgacatcgtcagtctgcgtctgcagagttggcataaatgttttgagatttcccgaacctactcctatacctacaccacctacactaccgctaggttccacattaccatttgcatttgcattaaactctacattaccgtttagattgacattggttccaaaatctactacaacattgggatctacacctcccgagcctcctgatccggtgtctcctccattgccgccaccgaagccaccacctccggcacctcctcctgagcctccgaaaccgcctccgaatcctccacttccaccgccgcctgatccaccgaaaccgcctccaccgaaacctccacttgcaccaccgtttcctcccccattgcgttttacatctttatccaaggtatcaatgagcacgttcaactgctccacaggcttgttcatgcccttgattgatttgttcaactgaatcgtctgatagtctcggacaatcttgttgatgacattcaaacgattctgtaaatcgttcataaagctaggattgatcttgagaggtagcaccatagactcgaccaccaactgttccgaattggaattgtcatagtccatgagcacctctgcaaccaccacgttaaactcatcgaccattggtttaatcttgttcttactgtcaatggtggtgagaaagagtctacgcactcggtccacagaagtgttgtcgttgttgaaagacgacttgagagagttggccttgcgctgaaacgtttgcgtttgctcctcgatttcattgtagcgttcggtgagcctacgcaaacgcaaattgatgcgactcatcatacgagtggccaattgtctgagtttcatatagttggtgcgtttctcgatcaacactctgggttggaccgaggcggtgtctatcatggcaaacgtgttgttcaacaaatcaatgtactgcagcagagcgtgcttcatcgatagcaaaatgtttctactgcgaatgtaggcaacgtttacattgttggactgtttgggatccaactgcgttaccgcattgtacacgatgggttcggaaatgtggttcatgaacgattccatcgtccaagtaccgtcgtcatcgccgcgacagtttcgtactcgagtctcgatcaagttgtgctcatcgtcaacgtccatgtttgcagtgcttgtatctaaaaaaatataatgtcctaatctaaagaaaatgcctatgctaaaatctacacttttagtgaaactctaacgtgatcacccaacgtttgcggtacaaagtttttatagtacatgaatcgattcttggggtttgtatagttgagatggtgctcaaacagagtcggcggataaatgtacagctggacgtcttgcaaagattctccgcagccctgcagcgtggacattatcaccgacattagataggacatgttgacgtcgggcaccatgttggcgatgctcttgaacactatcgcaccgagtacgagctcgttcttgcccacacggacaccgaccgtgcccagattcgaggatggatcgcgacacagcaccttggtgtacacatcggtggacggtgcatccggccgagttggtcgatgatgggaatcgtaaaagtataaagaaactctcatttttaaacttttgaatgcaaatgcatagaagcgtcaaggaatcattaccatttacaatcacaaccgatataggttattggagtgcacaatagtacgatttaaacgtgtatacacttgtagacttcatcttgccggacgttgtactgcatgcacagaatcatgatgactagcacgcacagagtcagcagagtggccgtaaacgcttcatacttggtaaataggatgcccatcacggtagctgcacacgtagacagtatggtttggatgctccaaggtgcaccgatgcacaatcccttggtcagagtctcgcaattgatcaacggatagtaccaggcgtgcagtacgttttcgctcttgatcaggagctcgttgagacactcgctgcacgcatacgtgaccgtcaatactcgatagtgcttggtagagtttaaattcaaaaagttgcccttttgatacatgcccggatgaatctccaaatccaaactgggtatgcgtatgaaatagtgtgcaatgatgaacgaagagtttttcaaacgcttgatgcacatttcaaccgcagtctcttgcatggttagttttgtttaaaaaattaaagcatgcgtctctatacttgttggcggcgataagacctatagcgtattatcgcaaagcagctaatcgagtattgtgaattgaacgataaaatggtgtttactcaatttgtgtcgtgcacgctgggagcggtgctagtcatcgctctagtttttttggtagcactcatcgtgtttggctatgctgtaaactcgatggtactctatagatcaatctttaacgttggcaacgttttggatgaaaacttgagctttagagatttgtacactttgtgcaagcgactgttgatggatcggtacgataggctgtttgatacaaagacggtcaaagaggccaaagagtcggattcaaaggttgaggtagaggttgtaaagagtgattcaaatgttggttcaacggttgattcaaaggctgatttggatgttttagagagcaagacggaagagtccactaaagagccctctaaggaattgtctaaatcagagccatctaaggaattgtctgaatcagaaccctctaaagagccagagccctctaaagagccagagccctctaaagaatcagggagtaaatctaaaactatagattcggttgatggtacagtaaaggacagtgttggtaaagacaatgacaagagcaaagataagagtacggatgatgatgaagatgaggatattgaagagctcgactactatgcagacactgtgaacgaagagggtttcagaagaggtgattgagttttagagtacaatgtcatgttgcattttgcatcaatgtagcagtagtgttgcatagcggctaataataagagtgtttaatggtttaggtaggattggttttaggttgaaacattgagacacagactgatttagcaacacacgtttatttataaagtttacgggttaatgttaatgttaaggtttaacaatacttgttatttgcatttacttttgtgtcgacttaagttgcatttaattctagattgtattcatagtcttactttttacactggtaattgttctagttttttaaacacttgtaatacacatttttataaacttttattacaaaaaatataaactataaatataaaattataataaagtgtaaagtgtaaagtatagtacaattgtaaattgtaaagaagtaaggatgattctaaagtacaatataaaagtattggtgacttaaactaattcttcaaacatgtacactctacactcttacaacatttatcctcctacaacctctaccctcatcctcctacacatcttccgcatcctccatctcgacagacttttgatcattgcaacactctagcctacctgcaccagaggccaactctttaatgtagcgcagagacgttactccggtccagtccttgtcgcttctgattctaatgacacgcggaaacctaaaggataggctggccgtcagctctgtgcacagcacctcaagcaccggcatctgcttgggatcgagtgcaatcatcgtgggcagtttgcgtgaatccttgacgttgacaaatcgccagggcacatccattgcggccgagtgcaccatcaacggttcaaggatgtcgttgagttgtttgatttgtacatcgttgaggccggcgtgcacctttgtcaaacccacccatgtcggttccacgcaatcgccatctaagcatcccatcagaaagacggagagtagtcctcccaggcgaccggtgccgtaccaggcgcctaggatgaccaagtcggcagtgtctccgctattcttaaagtagtcgcgcttcatctttagccatctacgcttgccgggcatgtagcacgaattggcacacttgagcatcagaccctccatgtttaagcgcatgcactgtttaaactcttccataaggtcaccgggtgaggtgatgtgcttctgttcagagagaactatacgattctcgatcagtgttaggttgtctttgataatgtctcgccgaacagacagaggctctcggtacaggtagcgtccgttaaagtacatgcaatcaaacactacgatgcacactttggcgcttttgaacgctttacgcttgtgcacaccgatggcgtcaaacggtagaaccttgccagtgtccgtgtccatcatgagcagttcacagtctaggatgcaggtgcactcagagggcagggctcgttgcaacaattgtgttaggtcaccgagcttcttttcgggtacgcatttcagtgagcgagaatagtacttgaaatctgagcgactcttgtgtatctggactcgttcaccgtcgtacttgtactcgcacatcatgccattgggaaactttttaaaggccacctctatggacttgcactgggcagccaacatcggagccactgtggccatcggttcgtccatggttaggttcaacttggaagatagatttactcgtatgcgtgcaactttattagagtttttaggtttataacaatagcgtatataggtttgtttggttgtctctggttgaaatgggtctatgcttgtactattggttatacttgaatttgtacttgtgcttatatttgaatttgtacttttatttatacttgaatttgtactcgtgtttgtacttttggttatacataaacttgaacttgcatttgaaactagactggtatttacagcactggtactggtattggcactggccaagagttttacatcatctgttgtgtgcatctttgctagcattttaaagtactcggaaaaggatagagtattggaatttataggattataaagagtcgttggtagagtgttatttgtggacagtgtatcgagtttttgagtttgtacaattacactgcggtagagggattcttcaaagtcaatctgtgtattgactccggagcctttggtacttgtacctgtacttacacttgtacctatacttgtatttgtacttgtactcttacttgcacttgtacttgtactcttacttgcactattcataccagtaatatttacaacacttggactagcactcgccataccaatactgctcaactttgtgttcaacctaggccgactcttggacatggatgtgactgtagatgtaggttgtacaaaattgtcaacacagttggccttactgccctttggtgtagtgcatcgtaaagagtctatgggtctcagtgagattactggccgactacccagagtgtctacactaatgtgattgagtatagtgttgatggtgccagtgttggagctggatggtgtgttggtagtagagtttacatcatgttgtaaatcaccatcaacactagattcaaaactacactctacactacactccatgttacaatttatactacaatccatcactctacaatcttgtactttaccgctaatgctactactaccaacaccaacaccacaaccaccaatacctatagaatctaccacacttgcagtatccaccgagtccttgcacattttacatttgcaagatttacgacaccctttgtggttagacttggcttgtagtttgggtggtctcctttgcggttgcacgtgcacaaaattggccttgtcgtcagagtgcaagggattaaatggcaccgtattgtatggtatactgttgaagtttagattgttaaaagttgtgttacatgtattgtaggtggtgttgaacggcgactcttggaaatctaaatctaaaatagtctgtggtacttgcaagttttcaatgggagcactagtaatgttgttactgcacgggttgttaaagagtggcttgtccgggttattgaattcactggtattggaattgtatgcattggattgagagttattgttgttgttgttattattatgataaatgtatggctctttggtattataggattgtaaattagaattggcattataggaagagtgtgcattgtcggatatggtagtttgaatattattagatgttggttggtcgttactgttgttggcataggtttgatttatattaaaggatggttgatttgtattgaatgattgatttatattaaaggatggatttatattaaatggttgatttatattaaaggacggttgaggtgtatgatttgtattaaaagatgtttgaggtgtattaaaggactggtttggatttacattaaagacttgattgttgcatgattgattaaggttagagtcaaaagcttggtcgacatcaaatacttgattattattaaattgaaagtctaaattattaaaagtattgaataatgatagcgagtctatagcactgtactggtcgatgctatggttcataatgttggtgggctctacattagtaaacggtaaaggttccatataattgaaagattccacactattgagaggtaacgattccacactattgaaaggtaaaggttccatgctattgaaaggtaaaggttccatacaattgaacgattccacattattaaaaggtaaagactcggagttcaccacatctcctagtacattgtttgatgtacactctaccaaagaccaaggttctagagaattgtttatagggcctgtattgaaagtagtggtgcctgtattgaaagtagtggtgcctgtactaaaagtattacctcctgtactaaaagatgaaccagttaaatgattacccaacacacaactagcattttcaaactgtacactgtcctgagaattattgttagtattattggattgatgcaattgcaaattatgcaaagtcacatcatgggaatttattgcatcgtttgaatattgaaaggtaccattattaccattattaattacattaggtatagtattgtacagagctatatttgtacacgtacactgtctaaaagtagttgttgtagttgtgttgtagtatagcttgtacgggttctcaaacttgttggcatgtaacacatccgtaacgtcctgaatgggtctgttgattctatttgtgtttgttttactgccagactcgtagaatggatcttctaaaaaggtcgacgcattatcctctccgcactgtaggtccagtactagtttgaaatctttggacagttgaaacatcaagtatgcggtgggcgacaacgcttccagtatgcactttgagccggcgtttattttcaagtcgcgcttcattatacgaattagatattttagttccatagagttgcatcgtctggttatctcgtacaatagtgcgtgtttgccagtgattgaactgtcagccatgttgcttaaaaactcgtcaacctgaggcatcgtgattctttgtctctcttcttctttacgtacaaggggtctataaaaggcctcagcgttaacgctttcattgttgttgtaaggtttagatgcattcttgtcattagtttcttgcaaaagaaaattgcacttgtgtggtttattacactctctgtgaaacttgtaatggtgttcgttaaagaaactgattatagtctgagccacgtcgccggttctctccaagtctttaaacattaacgtttgtagcaattccactcttaacatttccaatctattcaatttagcaccgacatcgttacttttgcaattacagtaaaagcgtgtcaaatcgattccattactattgttgttactgttgttgactagactgttgaagacgcgagcgtacatttttaccaactgtctagtcttgagattgtacactctggggtcgagctggggcaatagcatgcggcaccatagctttacgtcgtcgcaatagtcaaagaccaccttgacgatttcaatcttttccgacatttgatcggttgcggctacgcgttcacacaagtgtgcaaagtgttctagggtatagtagtaggttggtttgttggtattgtttgagcgattgcttggatggttacttgtagaatgtgtataatttggaggatacttcttttgatggtaattttgatgatggttgtaggatgatggagtatagttttgatggttataggtttgattgtagtcttgcttgtagttttgattattatagttttgattgtagttttgatggttatagttttgattgtagttttgagtacaagtacaagttggaggatgaggtattggtaagttacaacaaatacccttgtaacaattgacacacggttgttgattctgattctgattctgagtctgagtataagtatgagtttgcgtctgattctgatactgttgattattcacattatactgattgggatatattgaatttgaatagttgcaagtccaaggtagaggattaccgtgatgctgagtagtagtagtatgagtagtagtatgagtagtggtagtaggcgtactagtaggatgaagaggtggattgtaaagatgcagacaaaacggcaacgatgtgtgcttggctagaggagcatatttagttgcaagtgtaggttgtttgaacaatctcttgggatacagtaatgatgttctgagtagagaattgttactgccactactattattggtgcttgtagttttacaaattgtgttgttattagtaaaagtagtggtagcagtagtactaggactagtactgatgctggtactagcactgatactgctactagtattgatattgctactagtactgatgttacttgtatcaatactagtagtagcagcattagcattataatcattaccaatcttaccacactttactggacaatccgagacacactttgaaaccattacactaggaccatccattacactaggaccatcactaatgtcactaccaatgtcactaccaatatcactgctagtctttgaaccggtagactcctttgcatgcctttttctgcgcaccctgtgttgccgatgcctggtgtcgaattcttgctcttgttgctggtgctgttttgtacaattattattggcaaactgttcacttgactgaccgtccacaatggttgattgttttgtattggattgcaattttctcaaattgtaccttttgtgttgagcggtggcattgaccgcatcttccatgaccgtgacactctgattggtaccacatcttttattcttgtactttttgtgttgatatgttttagagtgatttgtagcatttttgaatttcttgctgtttttgtgtttcatgttttcagtgtatgtaaatcttgcaagtgtaccaatttgtgtaggtgtaaaatataagtctagtattagttgtaagtagttgataatttataatttacagtttatattttatagtttatattttatattttatagtttgtagtttgtaattgtacaaataaatggtaactattattcactgtacactagaataataatgcaccgagtttttaatcagtcgcacacgcacaactcttgaccgccacacggtaaagtatacaagcagcgtatacgacatcaggtattaactctgccaatatatataactgtgaacaccgttaatactagcagcgcagtatttatcgttgataatattgtatgattttaacgaaccattaatccctctgtgtcacaaatatagagtctaggtgcactggctgctgctgttgctaatctgtcgcgctctatggcactacacctagtacagatcccattcaattttaaaatgcacaacaagcatgcgcaaataatcgcacccactatgtatttatttttacgatctcattttacgagtttcagataatgaacctgagcacgggtgtgtagaacaaacatccaaaggatatgattataaatgggaaatggataaatgtgggaaatggttaaagtgtataaatgcaaatataaataggattatctaaattggttactggttgataataaatttgaaattaatacagatggatataaatgaggggtatagagaggaaggtgtaaaatgtggagaagatcacaggaaatgcctaggtctgtacacatgtatggttcctatacttgtagttttatttctaccaatgcgcacctactacctatagtagaagtttatttccatgtataaatgtggtgctgtgaactgctatgatgtagtaccgtttattgaggaagtgaactaaaattgaaatgaaaccacttggctattgtttagagtctataattaggtgagcttacaatctcaatgtgtagtgtgtgtaggtaggtaggtagataggtaggtagggtggtaggtagataggtaggtattttagtatatggtcttttatcataggtaggtagttttatagtgactaaaaaacaagaatgtactcaattaggtgctttatttttcaaagatacaattttgagaatacatgaatatattaggattacattaggattacattaggaatacattaggaatacatgtaattataatatatatttgattaaatgagtattacagtctaatacatgctttatattttactctaacatcctactctaccaactattctaccaacctagtctacaacctaaactacaaactaagctaccatttaaagatcattgtgtggccatacttagtctcctactctccttattattacaagtgcaatacatctaaacaatgcatctaaatgatacatctaaatgatacatctaaatgatacatctaaacactacatctaaacgatacatctaaacactacatctaaacgatacatctaaacactacatctaaacaatagtaccgacaccgtacatctaaataaacatctaaaagtacaatacaaaactaggataataaatctcaacacaaaagtttggcattacaatccaaaacaaaggtattctaattaatgcaaattacacctctaaattaaacctctaaattaaacctctaaatcaaacctatgactaaaatgcaaacttgatgtcaactagatgttatacagtcaactatacactagatgttatacaatcatagatattacacaatcatgaaagatgttgtaattatacatcaaactagctagatattgtacagacaacattaaagcacaagaccaatagctaaaaatgtttacatggaataaaggttaatctatagtataaatgtagaaacttcaactaaaatgaaaaatcattatcacaccaatcgtacatcaaatgagactggttcacctttgccgtagaggctgcgctcacactgctaggatagattacattggtggccacggtaccggtgctcgtaaaactactgcccgtactgggaccgccgctctctacgacctcttcctccatagtgtccataatggtatcgtccgtgtccaagttcatgggtgcttcaaagagcgagtctttgcgttgcgcatactgcacaatgggcttgtcatcgatgagggcacagtcgacaaactcttcactcttgtcgagacacattacgttgctggctctgtgcaactttgcactagacggcatcggatgaatgtctagagaaggcagactactggtacaaccaccaccattgggatcggtttcgacagtgtccgagtgtaccggtatatagccagatggtgcatgttgtggttgttgttgttgttgttgctgttgctcttgctgctggtttatctcgctaccaaactctagatcgtcctcgaccaaatcaccgcctcgtgtatcgagcacggtaatgtacttggtgcacatgttaaacgaacctctaccgttcaataatacatcggtatcaaacttggactctcgggcattgttagtagtagtattattgtaattggtgttgtaatgataatttgcatcaccagctgtttcccgttggtttatatcgcagtttccgttaggatcctgctggccgatgctgtataagtatttaaactctttaacaatctttttgcgcacctgcaacgagtcaccgctatagttggcgttgtacgtttgcatcaagtccaacagtcttacattgtataaacgtttagttttgtgatcaatgttaaacagagcaaacatgaccacgcccggtggaagtgtaaacgatactgtatagtcgctcaaaacttgcatcgaatgtacaactctacactggaccttgtgtgtatttttcaactgatttattggcacgtgtaccgcagtcactcttgctccagatttgttaaaatagtaataaaagtgcggaaactgtttagcgcgacgattggcataacggtggcctctgttgttgttggcagtgttgttattattattgcctccagtactacaatgaccattgtttttggtactgtatggatattgattgtgatgttgttgttgcttatacaggctctgattcaaactcaactgattttgattcctcacacaattgtacactgcaccaccaccacgacgaccaccgtcaatgccagcatcaaaaccagcaccaccaccagtgccagtaaaagccgaggcaccgtaatcgtactggtgtcgtctgcctccatcgtccttggcaagcttgactctcagcttgtgcggttcgtttgaggtggttataaaaccgatatggtcactctttgaatcggccaacactcgtcgtgtacactttaacaaatccggatccacagtattgatgcactttagactgtctacaagtttgggagtgacgctaaacagagtctttgtacatttggcgttcttcataaacatgtagccattctcaaacaagggggtattctttgtctgtttcagtaaatcatgcaatgcgctaatttgtctctgtgccagcttggctactagctcgtaatggaaactcttgtaactctcaaatttctgatgttgattattgtgattgttattataaaagggtgcatgttgactctttttgattgcacccttgtagttcatggctacgatatagcgttcggcattggccggcctggacgtgttcggtttgacaacggtaaactcttcaaagtgcgagtaaatctcatagtacagattgagcatctgattggtgaatgcatcaaacgttttcaatacaaaattaccacccaccttgatgtgatcaaacgccacgtccacttgggctcggatcaggtcatagttgagcggctcttgtagattttcacggccacggcaatcgatcgatccatcggccaccaccaggtccactttgacgatgcccatatcgtgtcgaaagcgatcgcgatcgtgagcgttcaacaggtccacagtgtacaccttgacggctgccggattgggtagcttttcaatctgcaccggcaagtctcgatgctgtagtacgatgccaaagttggaccaattcttgtaggtcaggtactcggtaaaaccacctggtccagcgcacagatccataaacaggccggcatcgttgctcagtctaaagttgctcaattgatccatttcggccagtttaaagaagcaccgatttatgcacgattgcgatcgcaccatgtttatagtctcgtcggtgttgttccaggtcggtagttttgatttgcaattcttaaagacgcgctccttgagtctgacgagtttttgacgcaacgtactcattagctcgtcggccgagttgcaatcgtttgtggatgcagataccgatgccgaggtggagacggacgcagagatggatgaagcagatgtagaggccgataccgatgccgatgccgagttgtgtatagtggcattggcggcatcggtagcagtggttggaggagtatcattagtggccatagttgtagcagttgtcgcagttgttgtagtagtagggttggttgtattaatgttgttgattggatttaggttgcttggatttaggtttaggttagagtccgagccaacagcattgatcgcggccgttgtagtaatcgtaggtgtcgtaaactcttcgccaccaacaccaccaacaccactctcaatgcaggtactgggcttgcactccatgggttccatttttttgtctagtatttaaattttatttattcaattttattttaatttatttaaaaaccacaataatacaataggtagtactattagtaggtattgcagtccagacagtccacactggtcaacagcaaaagcactatggttggtgtaggtgttgtgcgcgggtattttatacttgtccgtttatctatcctatgactgtgtactacagcgtaggttgttttgtttgttttggtttcaaagtagcaacactgctatatacacacgcgtatttatacaaagtcaagtccatgtatattgggcgactcttgttttcactgcacagattcattaacaagcatggtttatactataaaaacagtaggtactctattatacactgtttgacttttttaaccccagtctaaaaaactagaaatgtacaagtatctagacatctccagtaatgatgtacagtggacagtgtgcgtcagactgaagtcagagtggcaaaagtttgtatgtaatgctatacatacaactactataatactactacatgtagggtggtgcacacactgcaaaactcccgtactcgcccggttctggtcactgaatggtgtgaaataattcactcgcttgaaattgaattcaaccttgatgcacacataaaggtggattaaaccatgtgtttaatgtttggttttagagtccaagttcttgaaagtggactagaggtttatggctagctgctgccggcatgtagagctactaaatgttacctatatatgcacacgtatacttgctaaatgtctaccactacctaccgacacctttacactcggcactttacctaatgtcataatctatgatgcacccatattaaaacaatactcttgaccattttattacaccctggttcatctactataaagttttattctctattgtgcaaaaagtacgtgcatgcgcacacattacaaaagtattattattagtagtgtagtaaggttacatcacacaaatcacacacacgatactgtaaaccatttataatacctacccacaatatcaatcctataaacctacacaacaaaagtccattgttaaaaaatacaagaaaaatgtttcataaactacaatactgaccggtgaaataacaccaataggctattgctttatactcaaacctgagaatattgatacttggccgtgatgaaaggttatgaaaatggccagaaggaggaggtgataatcagaataatactttgtgtcggtttttattaagagttgaacatttgttacattgttgcacacaattgcacaacactgtttcctttgttgttgtgtggggtgttgtggatggtgtatatgcatacctataccaaacagttgttttgtatgccaaagactagagacgtttagaattttggatagagttgtagatgtagatgtagatgtaggtgtagttttttgattaaaaaacaagtaattttttgactaaaaaacaagtagatttttacaagtgtttattttttataaaatacatttggtgtaaagttgtgatgaaaatattctcatttgttaaagtatcaactaatggaattttgtttaattatcaactaatggaattttgttaaattatcaactaatggaattttgttaaattatcaactagtggaattgataaatgaaatctgtttctatttctaacaacataagtatagagtacaaacataccagcaagtatgcatattatcgatcaagtatattacaagtaaaatatactacacttaacctaatgtgcaaccaacctctacaatcaaaatcttaacctctttcatattaacctataaaattaaaacacaacatacattgtttcttatccgcaattattaattaggtctaaagttatgcttgttcagttttagaccgtgtgtacgctatggtacagtttaaaactgcacaggcatttacatttacaaagtaaaacttttgcatttgatacactctgtacactttgcttttaatacgttttagataaacttgctttcttatctacactcgacactttgcgcttagcattacattacattacattattattatgatgtgcttatttaatcttctaggtcggccataaagtctgccattccgttgtactcttcgctgggttctgaaacaagagaaaaggtttatgattagttaaacagtttataaagtagagccattatgggtttattagattcgactgtggagtttaaattcacctgattcgattttacgtttcgcttcctcgtcggctttgcgtttggcttcggcggctagttcatctctaatacgtttttcctctgcaatacgtttttcctctgcaatacgtttttcctctgcaatacgtttttcctctgcaatacgttttcgttcggctgcttcagcatcggctttgcgtttagcggctgcttgttcctctctaatacgtttttcctctgcaatacgttttcgttcggctgcttcagcatcggctttgcgtttggctgcctcagcctccgctttgcgtttagcggcagcttcagcctcggctttacgtttagcggctgctagttcatctgcaattctttttcgttcagcagcttcagcctccgcttttcgtttggctgcctcagcctcagctttacgtttagcggcggctagttcatctgcaattctttttcgttcagcagcttcagcctccgctttgcgtttggctgcctcagcctcagctttacgtttggcggctgcttcagcatcggcctttcgttttgctgcctcagcctcagctttacgtttggcggctgcttcagcatcggcctttcgttttgctgcttcagcctcggctttacgtttagcggcagcttcagcctccgctttgcgtttagcggcagcttcagcctccgctttgcgtttggcggcagcttcagcctccgctttacgtttggcggctgcttcaatctcagctttacgtttggcttcggctgcttcagcctccgctttgcgtttagcggcagcttcagcctccgctttgagtttggctgccgcttcagcctcggctttacgtttggcggcagcttcagcctccgctttgagtttggctgccgcttcagcctcggctttacgtttggcagcagcttcagcctccgctttgcgctttgctgcttcagcctcggctttacgtttagcggcgtccgcatcggctttgcgtttggcttcggctgctatttcatctgcaattctttttcgttcggctgcttcagcctccgctttgcgtttggctgccgcctcagcctccgctttacgtttggcttcggctgcttcagcatcagcctttcgctttgctgcttcagcatcggctttacgtttggcttcggctgcttcagcatcggctttacgtttggcttcggctgcttcagcatcagcctttcgctttgctgcttcagcatcggctttacgtttggcggcgtcctcatctgccttgcgctttgctgcttcagcatcggctttacgtttggcttcaccatcgtcaacctttggtgtttcttttattgggtcctctttacgtttgggttgttcgatagtttttggaattaccggaggttcctctttgcgctttgactcttttttacgtttgggttgttcgatagtcttgggaggttcctctttgcgctttgactcttttttacgtttgggttgttcgacagtcttgggaggtacatctataacctttggtaaagttggtggagtctttggtggaacatctacaattttaggaaattaataataataataataataacatctacaatttaataataataacatctacaattttaggaataggtggaacatttacaattttaaccactaccagtactagagccagtaccggagccagagctaccagtaccagagctaccagtaccagagctaccagtaccagagctaccagtaccagtgctaccagcagcctccttacgactctcttcgtccaatttgttgaacgcattcaatagcgttgtagaagttatttcgtgctcggaagactcgtcttcatccgattcgtaatctggctcactttcaaaatctggtacaagtgagctgggaatagaaccatcctttggtttaggagtttcctttgctttagcttcctttgctttagactcatctgttgatttaggagtttcctttgctttagggtccgctgttgatttaggagttgcctttgctttagacttctctgttgatttaggagttgccttcgctttagattcatcctttgctttaggcttctctgttgatttaggagttgcctttgctttagactcatcctttgctttaggcttttctgttgatttaggagttgcctttgctttagattcatcctttgttttggattcatcctttgctttcgaaccctcaccatccttcactttaggcacatcagcaagctccaactcttttgcctttttgcgcttctcctcagccgctttggccgccgcctcatcatattcagcaaacgcgcccaaaaaggctttagctgaattgtttcgttcatcatggtcagtatattcgtcttcatcagagtcagtgtcaacgtctgtgtcaatatcctcgtcagattcaacctcgtcctcagtcgttttacccttgcctttgcccttgtctgtccccttgtctttccccttgtctttatcctctgccggtttggttttatcctcggcaggtttggatttgctctctccctctacagttttgttctttccctctacagttttattcttggtctctatagtttgattcataatctctagagttttgttctttccctctacagatttacccgtgtccccagccttgtccgtatccccagccttgtcctttcccgagtcgtcaccatctataaacatacaagagatattcattagtttagtcagtatcaaatcaagtagtgtaaatgttagtaagttttaaagcaagtgcaagtttgttagtataaagagtatagttgaatagaatagaatgggaagaatacatttacaattacacattataattacacattatataaatatatacacatatgcatacttggaaatgcaaaccaaacaaaggtaacccaatacgcgcatgcctctatacctacaccacactaccttttcttgcttcagtttgtgtagtttaccaatggttgtgtattttaaatacctgatcaaaataatcaaaacctttacaattgtaaaatactcaaagcaaaaatctccaagcaaactacacaaactataggtacatgcaaatctattataatttacaattgtgtacaagcctgcatcctgcatctacaaatctacattactaaaattgacaacattcaacaaaacaacaacacacactataaaacactacatcaaaaaccacccatttgatgaccatgcggccacttgcctgaaagtgtgcgggtgcctgtagttgtaccagtgtgccagtattgtgtatgtttttagtttgtactcttgtttttctataaacctatcatgtataccaaatcctatacccaacagttttaatgttctctctttgtatttgtgtgtataaacaaccatagtctacaatctaaaactagtaatgctactactactttcctttatttacactacctatattacactacctaggtatattatactacctatatttttacattctattttaaactatgcctccattttaaactatacatctatttcaaagtatacctccatttcaaactatacctctattgcccctccctctctagcttttccataattctactaggcaacgctgccacaaacgcatcgtaatcctcatcgggccgtttcaattctttgcctgaatcgagtaccattcgcgtgtacttgtacagtttgtcaaattcagcaatctcgctagagtctacgattctagatttgcgcctacgcagagcatcgtccacgacctcgtcagtgtcaatcgactcatccacctcctccaaagtgggaggtagaaccaattctacaatctgtggtgccaccgtatccatattctgccgacgctctctgccaccaatcggtgggtcctgtgtaaagaagcttcgatagtcaaagtctttgacatcgcccaaccaacccattattgacagaggcaacagcgatatgaagaaggacacgcacggtacagactcggccgaaaaggcgtgctccacaaacgtttcctgagtaaacataatgttggtcactataaagtatcgatacgtgtcatagtcaaacttggactcgtcgtactcgatcgttttaaacgaacccggctgcaccaccgacggtgtgactagaaactgtttcagctgttgactgctggctatcggtacggtaacgttgtagtagcgatcgttcataaacactttaaactctatcacggtaccgttcttgatgagtttaccgtcaaacggcaaaccctccaccatgcgaacgatgcccgtattgataaactcttcggtcacgtaaaaggcgccctttgtcgtcaacagattggacaggctgtacatgtccaatggctgactgcgtttgcgtctaaacattgcccacagtacgtgaccgtcaggtgccagttccttgtgcaccagatcctcatcgggatccttgaaaaagtacggtctattggtactgtagaatgtcatggccgacttgaacggtacccgctgtttggtctcaatgttttcatagtattctgaaaagacgatagccttgtcggtatcgctgaccgaaacgctaaccggattatccacgtctgctacacgattccactttttgacattaaacggcctacccttgaagagatcgtactctaaccacggcgatgcatagttgtagcgaatcgttataggattggttacaatcaattgatccgccagcagtctgagtgcttccagagtgccaacggtgaccatttggccagttttgtctataatcgaaccgggcactcggatcggatcgtcggtgagacgtttgcgcgtaaccgtatagtattcaccggatcgcgtttccagagcgtaggtgactgatcgattaccggtggcaatcttgtgaatcttgttgtctatgcacttttcgatagcgctaacgtacgacatgtaccggtagtcttgaatctccaacgctctgaaatgatgctccggattggaatcgtaaagtgctttgcaggccaacgacacgcactccatccgaccgtcgggatgcgtgtagataccgtcgcgacaagacactatggcctccgagtagtttatgcattttaggaaacgagtatcgtcaatctttagcgtaaacgtgtttggtttgtcgttacacaaattcctaaaagtacaagttttaagaatcttgctataaattagaccggctttgcacgatttgagtatgctagttgaattgtgacaagagtagtattcatattcgctaggcgtgtaatcgttaattttatcggcatgagtataaccgtcctctttgttttgacacacgtcataaaatacgcacggatcgctaccggcacggtttacgagtttttggttgtagactttgttgtttatacaacgaccagttttaattttgacttttgggttagaagttagttgatccctaaattcatagtcggcatcgtcgaccaccaccggttccgtggtgggtccctggcacactgcgtacacgcgcggatggtacagtgtgggcgatgaggcatccttggtcggcagacccttgattgtaccgatcgggtcgtcgacttgacatatagctttgggtttgcacatcttttccgaatctcgccagatccaattgtccggacacttgaacataccttcaatgttggtcactgtgaaaccctcatcggacacgttctctattagacccttgcgctttttggcaccgctggcgtcgtctctagccttgcgcttgttgttgactctaccgttgtcgaccgggttgcctagattgtttatcggcaagtcttcgtatttgcgcactagcttacccaaactgtcgacatagtagttttcatatttgttggtatccttgttgtagcgatacgtaaacgctacggtaaaggtgccattctttttcatatgagtgcttataaagtctgcgagttcgcgtggtgtcttaatcttggtggcgttcaacgtatgcaacgagaaccacatcaagatgacggtacaaatgcacaccacgctcaacgcgatcaaactgactagcattccaagattcatgatgaatacacgagttgctctgacacactagtctgaataaaacggacagcgtttatcatcctttaaaactttgcacatatacgcataacgccaatatgctcttacatgtagtctaggcgctgccattaaatggcgacttctcgattgtttgagattggtcacaaatgatttgacacgcacaatgctgctattgttgctggtcgttgccctctttgtggttattgtagagcgattagtgacaattcccttgtgcgaatattacaagaaaggtccgagcactgattctaaaaaactcaaagacacacccgacggcagactactagcgccactgatcgatacagtgtaaactgagcttgtgcgactgtgcaacaatgaccgagtacacatttaaaaactttaagagtgcaacgaccgaactgattcatctaatcacgcgcatgtacaattcaatgcagccgttgtatgacaaggctcagggtaaaataaactctgttcgaataaagctactgcgcgattctgtagacttgtacgacttgcattcctttttgaacgacgaatacagacacgcgtcgcgtacccttagcgatcaactcaacgacttgacattgatcaccacaggcatgaaatatgacacgtcaagttttactactctgagacgaatcgtcggtcgcaccctaaacatcaaacgagtctcgatacagacctacttgaactttgtaaatgtttacaacaaggttattgccgcatccgatagactgttgcagagtctggatcgagtacagacattgtacactgtaccgatggactttacgtctgtggttgtacgtggagtgcaagggggagggagtggtaatgctagggatgttggcaatctaccgatgcctacatttgtagagaatgtaggtcctctgaatactaatactaaaactaatacaaatactaataatgacaacaatccatcaaactatagtattgtagaagtgcctaatggaactttgaatgcaagaccactcgaacagattgaagagtacgattctagcaagtatgaaggtatgatggattatgaaaactttgcagccatggtggatcgtaaagatgccgactatctgaatcgaatacgtagcccagaatcagactcgaaattgaacgtggccagctacatggacggtgtaaagctcgagcccgaagagaccaagccggacgtgcacgtaatcgacttgctcaacacgatcaatgacaaactcaatctaatggagttggccatcaatgacttgtcgcagactatacacgaaccagtcaagggtaatgatgatgatgtgggtcaacaccaccactttaatgatgcactccaggatcgactagactcgatggccaaatccaacgaaaagcaaatcaacgcgttagaggatcacttgactcgtttgattgaagagggtaacaagaagagtagtggtagtagtggtagtggtagtagtagcagtagtaacaatatgcctaaaattgacgctataaaggctgccatacaaactagcctggaatcgtatctggtagactatatggaaccgctgctggatcgattgtcggtacgcctaaaaaatgtagtcaatcaaaacattgaaaactttatgcaggcccttgtggagagcgaaaaggtgcaggatgaacgctaccgaaacttgctcactcagaacgaggaaattgtcaagtttttgagcatgttcaactttgagcgtttacagagcataatgcaacaggtggtggacggagtgcgacaggtcggccagagccagataccgcccgagcagatgcgtcaactgttggacgagctcaaaactctgaatgcatcgcagcgcatcagttcgattcaaaccattgccaagttgcagaatgcactcaccgtactgggttcgatggccgacactgaggcggtgcgagacttggaacgactgctcagagagctagagagctttacactcagacaggctggcgttgtgacttttgacgagttgcaagcagccaacaccaataccgaagattggtcattatagtgtttgtagaagattggtcattatagtatttgtagtggtgttgggggagattactataatgtgtatttagagttatttagagtggtagtgtgtttagagagagggtttgtattgtatccagagtggtagctagttaaggtataggattgtgtagagactttagtaacgtgtttaagtaatgtatttattaaatgggtgtaggtaatgtattcaacaagtgtatttaggaatgtattcattagtattaatattttttggtatacaaaaaaatacaaaaatctacaattcacatagtgtttttattaagtttaatttcaaatacaattacaattacaagtacaattacacttgttacaattacactttagatgcccacaaactttaaagatcccttcaaatgcaaactacaaatcttacaactacaacacaccttactctaccttacacaaccatactctacaattaaacatttgaagcatacgttctaataaacactttatcctcatcctcattctcatcctcctcctcagactcctcatcaggctcatccgtaggctcattcacaaagtcataatagtcgactctaatcaacttgttgttatcaaccaaacggtaaccctttggaagaatggttgaaatatccacctcctttggcttgtgctctagaggcttcaattcatcctcagactcggattcatcggtactgtcaccatagtagtccttcaaatccaacgcattcggcatttggtcagattcaaactcttcctcactgctgcggaaacgcttaatgttgtacgtgtactcgtcagaggtgaatcgacgcttgtttgattgctcggtacccttgaattctttaccctgtgactctttttgattttcatactctttctggcacttgttgtcagtgctattgttgcaatctctagaaccgttggcacctccatcagagtcactatcgtcatcgtcatctgaattgtgccctctatacgcatctggatcaacatcattggaatcatcgtcctcatcctcttcgtcttcaatctcttccccgtcactgtcaatgtttacgtatccacgctgcgatctgcgtttcgtggactggtacacttcgataatcttactctttagaatggagcccaaaaaggcatcggccaacgagcccagtagcatagactcttgggcgatgatgctcttaatctcggtcaagtgatcctcaaagcgctccttggaaacgtgatcgccaatgtgatcgtccacgtactgtatgatgcgtgcaacgcactctccagatacacggaatcgatccactagtatgtgacgagtgtcgttgataatctttagaataacccaccgatcgataatgtccggcagttcagtgtctggtgcacttgaaggtgccgaatagttgaacatggagaggaaagaggacatggtgcggtttagagtttagagattagagattgaaaattgcaagtatagatgggtagagggtagtagtagtagttggtagtagtagtacgagtacttggtagtgatggtactctaaccggtatagtggctcaaccagtactgatgactatccgctcaagtctactgtatttattgcacggatgagtatagataatacgctatgcgtaataatgtttataccaattcaacacgttgttatcggtaaccctagagttcaacaataactaggtctttctatgttttaaactaaacacgcatacattcaaatttagatggattttccatgtccaaataaaggtacagttttacaagtctttctacatccaagagtaaatgtttaatcttaaaaaacaagaattcaacaacttgaatttgagtctatgcctaaactctacagttacattttattgtcatctaaagtaatactactatcaaacgtctctataaatcaactttatttatttaaacaaacttttaaagtaatttatatctaaacaaacctctacctttaaaataaactacatctaacacaaccctctaaagtaaccttctaaagtaaacctctaaagtaaccttctaaagtaaacctcaaaaacctctacattctacaacaacatatcctcactctctgtactctcacccctagacttggatctggaacgagacttgggctttgcgttcaacggtacggccgtgttgaatgcaaaatctttgggcggtggtcccatgctcaagtctgggctctctggtcgagtcttgggtgtggatagtttaaagggcttcaccgagttggtcttggccggtggcatcagtttagtcaagattacagacattacatttgacgaaaaccaatcgctcagagtgtttgtgtgctgctgcaccagagtccatgtcgtccacaggagcagtattataaagagcaactttataatggcgtgcatggacatggagcccaatacgacgccgatgagacatcccgagattaccaatgcacagttcattttgatggcgcctcttagactttcaaccaaatatagtaccaatacggtattagtgttggcactggtacattgatacttttaaagcaatcaaagacttgtgtacttttttaccatttatttccattcatcaattcaacttacaacaacaatagagtgcttaaaaaactagactttattgatttcaaaaggttacaagaggtttaagaatagttgctaaatacatagagtgcatgcaaacaatcaaacataatactaaacatgtacatttggtgcttacaataatattgcttttacataacaaatttctacgagtacaatttacttgaaaaccttcatcgcctttgctgccaaataggatagaatcggatactcagagtgtctatatttgtacacgactctcgagttgcgcatcttgttttgcacatccgtcttggactctttgggcacaacggtggccacgctggactcgtcctctgagattgaagtgtccgagtcttcagtgtcggtggttgtttcggtaaaattcatttcggaatcggtcgagctcgaggaacagctgctctgcgagtctgcagtgctggtactgctggcactagtctgagtgctctttgatgcaccgttgccgggattgctactgttgcttttgatctcgacactcttggcctcgctctttacgagcacctcttgaaagggcttgctgcgagtattgtacttgtgcatggcagagccatcgtccagtctagactgtttggctggcggctcctcggactcgtccaccattggacggtggccatagtctctagtgtacgagtcttcaatgtaggaaccgcgacaatcaaaatcccggcttatgttgtcggcgagagcgttgtcggcgagagcttttgatactttgtagttttcaacgagtttattgcaaaacgtattcgtcagtatagacatccaatctgcggtcaatggaaacttgtagccgacatcaatcactggccagtcacacagcgtggccagtgtgccataaatcacattctgagccttgacatacggtacaatcttgcaacgaaacaagtcaccggtaaccttttcgctcttctccagagtgtcaacgcctcggttaaacatgcgttttctattcaagagtatcgacgagtcgaccagtacaaagatgggaaactttttcataaactctagcagattcagattgagcgtgtgcaatgccttgtaggcgccctccatcagttcttgatcagaggacgcgtcaaacagtgacatgatgagtttccagattatattgttaaagacgcacctatccgtgacgctagtagagtactcttcgcaggcgtgcatcaacactggcaggcattgcataccgacgagatcgttaatatccttgtccttaaagccaccgtactgagacagtttgagcacctgaacggtaccgtcaaaatctggccccaggctcttttgagcgcagcttgtaatattgcgcagaattgtactcttgcccacacacgcagtaccgttcaaagctggcgatatatttttagtgtgctttacgaatctagtcagagtgtcgtcgctgatgcgatcggtgccgacgccacccgtcgtatacgtctttattacgctcatcaaatagtcgcgagtgtaaatcttgtcaatatccatttcgggaagagtttgccccaggctaatctttggcctatcaatcttgtaacgaaccagagactctgccggtagcggcatcgatagaatcggtaaaatcgtatcgttccacggcaccggtccgaacattgtgtctatcgtatagttgagtttagagttgaccagaagcgtttgaaggatccgcgacacgtcaatcagcaaatcgttggcagcgatgcacttttccaaatcgacaaccaccgtctcaaagaagcacattagcgcgtacaagtccgagtttgggtgcagtacgttaaacgagcgatacttgaaattgacatggtagaatacttcgcgcagagccggaggcagacactcgggaccatactctaggtcacagtctctaaattcgacaacattatgtacgtattcgccatagttgcgattcagtggctttacacacgagtaccgattgatcagatacacggaccgattgggctccagttcaaatttacgacgcacaattaggctcggttggagttcgctcgaaacgagatccaaatcgtcaacgtccgtgtattggtacatttttcaagttgatattagtatatgtatagatgtatactgtagaacgttcgtacaacgtttgatgttcaacttataaacttgtgctatttatattgcccatagcgtattgttaatatttcaacataaaatgtagtagagataagctttaaaagtacggtgcacgaccactatcagtaccagtggtgtggtgcaagtccccaagacaacaagtctgatccaatttaatttttggcttttgaatcaaccatggcctctatatctgcatcctctacaatttcctcatcatcctcctcctcttctgacgacgatgtaaacattactcttgaagtggagttggagaggatcaataaaatttgcaatgcagccaatgcgttcgagtatcgtcaaatcgagtcgattcaatcgctgcggcaactcaagcaactgatgatggagaatgtgactcgttccattgtagcgtatcccacctatcagggagagcgcataatcgactacattgtcggccctcaaactctaaacgaaacgctaaagtctaaactgagcgaggtcggagtctcttggattgtcgatgccgaagacgagtcggcaatgaatcgcaagactgaatggctcgccacttggaacgagcacctaaagagcatgtctaaactggaaacgtgcaaggtgcactcatcggacgagtgtcaccgagtcaggatcgcaatgattgtcttttccgtagtgtccaagtgtttgaataatcgcatctgcaacggtgcatccggagcctcggtttccaagctcgtgtacaacaagtgtaccatgctcgtggagcgcatggaggactatgccaccgttacaatgaaccatcccgaggtggctatgaccaatcgcaactatggcaacttttacaatgtgatcaagtcgtgcgatctgattgtcgtctacgatgctcagaatctggtgcagagcaacggctacccttggtacgatacctttgtggagaatgccagcaagttgtacctgtgcaaagtctcactggttggaagctgcttcaacaactatccgtgtcccgatatggacattcattaccgcaatcgatgcgttcattgccgcgtgggacatgtgtttcattcgatactgcatcgattcaacttgggcgaatgcatgcacattggcgacagtgtactgaggagcaagaatctagaagacgagtgcaatgtggacgtggagactgtggacgatgaggccaccaatctggccgataaactaaaggaggataccgatgaaaagtacaatattgaaaagtgcaatgaaaagtacaatattgaaaagtacaatgatggaatgtataatgaaaagggtatcgagactcctagtgtgattgttggccgagttggttcaggtttaggattgtgttatcgtggctataatggcaatggcaatggaggtggcagctcgtacaattacaacaactacaattacaacaatggtaacaactttaaaagtggaaacaggtatggtaaccatcccaacaattctagtttcaattgcaatggtggctcttttgattcaaactcttttaacaattttaccaatccaaactcttttaacaatcaaaattctttcaattcatttaacaactcttttagcaactcttttcccaattctggatatcctaataatggcaactacatgcaaccgactctttgctcttgcaacgattacaattgcagctttagttcaatcaattacaatagcaacaataacaactcttttccaaactatcaaacctgtaacaattatccaaacctgtattccaattcaaacaattattataacaataataacactccctatccgtgtccatttaacaacaacagcaacagcaacgccaactatccaaataatgcaccttttaatgacaatagcaatttcaactacaataataactataacaacaattataacaacagcagctattccaacagtagttataataacaacaactacaacaataactacaacaaccccaactttaacaattcattcaatcatccaaattcttttaatcaaaatcaaaacaattacaactcctacaaaaataccattagcaaagcaccaaacagatctgcttttacaccttacaaggcgccctataacaacaatcgtagatacaacaacaataataacaatactaatggttataattacaattccaagttttacaacaacaacaataaccgatatgctagaccgtacaagtatgatagaccacagtcgatcattaaacccattgaagaggataatgaaaatgttttgaaagagccaccatgcaacacttctacaccgttgccaatagagccgatacaatctgatgctgaatcaatcagcctagactatagcctagattcagacactccactgcacatgttaaagtgtgcattggaacaagagctagctgaggatgatgatttggtcaatttgtctgaggttgattataatgaggatgccaatgttgagaatgttgattgtaaggattccaagggtagggattctaaaggtagcgagtcaaagtgtagcatttctaaaggtagtgtcgattctaaatgtatggattatgaaaatgttgtagagagtccaaagagtgatactagtatcgagaatcattcaaagtgtgtaaagagttcaagtgtaaagagtccaagtgtaaagagtaagagttcaagtgtaaagaatccaagtgtaaagagtccaagtgtaaagagttccaatagtgacaaaactaagcattccgagtactcggattgtaaacctgaatataaacattctgattctaaatattctaaaacctctgattctaagcattctatttctaaacattctaaaacctctgattctaaacattctgaatccaaacactcagagtataaatatcatgattacaaacactcggactctaaacactcggacgctaaacgctactctgactctaaaactcttcctacatccaaaccacattctgcatccaaatcacattctgcatccaaatcacattctgcatccaaatcacattctaaatctaaatctaactccagacaccactcttatgaatccaaacatgagcaccgtaccaccaaaccaaaccatagagtctacaatgacaaagagtcaatgaaaacaccattttacgattccaccaagggtgtcgtttcggagcactctgtcgaacgcgagtaccatactgaggacggctacggtaaacaagagtacgattgcgatgaccgctcgtacaaggatcacgccgagttcaatgacgagttgcatcgtaaacgcagacgatccactactggttattctaatgctgaacattgttatgataataaggcttatggtaattctaaatgggtcaattcaaaggttgagcatgcaactaatcaatacaacaacacgcaatattatgatgatgatgctgatgacaataatgaggacagtgtacaacagtacaaggatacgtacagagccaattgcaagaataagcatcaaggctacaagaacaagaataggtctcactacaagagttttaaacactcgtacaatagtaacaacaacaaaagcaaccacaataacaataacaatttgtacaccaagccttgcactctaaatcagacgtatcctacaacttttaaagttaagaattataaaaagtacaacaagagtagcaatagtaacactaacaacaactacaacaacaaccacaacaaccattttaacaaactgaaaccaattacacgaccaaagctgaatcgtagactgccagagattcaggcagtgtggcctgttgatgtgccagctgatgaagaggaagaggactttgaatacacatacactgagaccaaaactagacacacctcatctaaagggtctaaaaccaaatcagtgtccaagtccaaatccaagactgtcaaacgttcctatgtagactcggaactggaagagggtgagttgtgtgatgatgaagagattttaaatttgttggatgcaccacgtaaacgcaaacggcactctgttggaaatttaaagtgcaaacgcaaactgagctttgattgtgatccgaaaaggtcaaggattgtgcatgattctattattgaacacgatatcgacagagaggaatctgggattagtaagggatcgtacaaagatttggatgctgacttttcacatgtagatggattgttttaatggttttgattgtttaagttttaagttttgttttaagttttgtattaagttttgttttgagttgtgttttagagttgaggtttgagatgtatgtcaagttcatatttgatttgtattttagaataaggttacgagttgaggtttgatctgtattttagatttacgtttgttctgcactttagagttgtgtttattctgcactttagatataagcattaatgttcactactacatagtttgtattattaaacaataaagtatttttttgttatttaaaaaaataaacatttaaaagtaaatgcatctttttcactgtactactacttccactttattactacgtccaccactaccactcctaccctatactactacaacatactttaaacctttaaatcctttaaaatccttcaaaatcctttaaaaccatttaatccgagcattattcacatttcattttaaaccccaaacatgcacacacaatctgcattcagcattcggtttattaccctcaagtcttgtgtgcattttatagacacaattatggtaccccattcatgggttgctttaaattggcataatatttgttgtttgcataaagagccgttccaagtaaaattacccgagctatggtaattatatgattgtaaagtagagtttacggtcacgaataaatgctactgtagacttgcaagtctcagagaggtgtaataaatgttctttttgtttagatgctaaaaaacacaaatcaagaatctttgtatttattgaggtattctatataaatcaatttaaaatctacacaaattgaaagtacacaaattgaaaatacacaaatctttaaattacatttaagaaactcctacacaaataatcaaacagtaacctccacgcacacattgctctactcgtcactctaggatacaactttcaactacaacctacaacctttaactctagcctacaactaccaaaacctaaatctctcaaacacactccctaaccgaaagccgtcaacttggcaatatcgccttcggcactcttcatcaattgtaccagtttgggttgcacattgatcactgtaatgttgccattgtcaccaccgccaccatcattcttggcggctatgcgcttcagatcaatctttttctcactggcctcaggttgcgccttttccaattttatggcattgggtgtggaatggctcattacaaacttgagaatctcctgaccgcacattgtggccgcagcctgacacacagactgtgcattgttcggagtacgcacaatgggcagtcggactcggctattgctcgtattgcaaagcatcacatcggacgcttcaaaatccaaatgggaaacacacacgctacgattaaagttgtgctgaaccgcctgaatgcaccgatccaactcgcgcagctcctctctggacagaaaggttctgcgactacacacgtactgtttgtacgcattcagaatgcaaagaatggtggcgttgtgtagtgcaatgtttttggacgcaggcgctacggcaaacgtttccagcgcctctgtgcatatacacttgtagtcggtcagaggtctaggtgtcggtataaaatgctgattcaatttgttggactgatgcagcttgctttgcatcggtttaatgtgcttgtacatgatgccgttaaaagttaaagctgaataataaaatgtctgaatttacctatagacacgtaaagtttgcaaagaccctactatattctacagttttacaacactaataagctattactattattatttattagaattaatggtgcaatattactactactactacctactagtacaaataccaacattgacatttcaagtaaacaaagagtttaaacattcaagtaattttcagtctacacaccaaatggatctatgcattcaccgcgtacgattcgtccaccgcattcaccctcctttatacgcaatgcgtgatacttgtcccaatcgtatcgattctcggcagtcaacatgactagcgatcgatccattgaaaagtcaaatctaaagaataggaatcggagcttcatagtttcatcgttaatctttgccagattcttattgttcgagtacacactgagaccgttgacctttttgagcacgacaaacggtttcagattcatgactgtatagtacgacgtccggccccacagatagtacatggacagcatatcgtacattagattgaacgtgtacggatccaggtactggacaaagccactagactcgggggccggattctgcaatttgaaatcgtacgtccaagtgtactcgtacagtttcagattgggcaccttgtacaggcgatcggtaatcttaaagttgcccggaaactttacctgatgatagggtcgaatcagtagcgtgtactcgtccttgtcaatcttgagcgcatcgaaaaactctttgttgtcgtctcgggtaaagtttatgcccagcgtgggataggtggtgtcctctaggtagccgtacacgtctacggtgtagttggaaatggccaaaatcgcatcgggcccctcatcgcctgccagtaggcgctcgtctttgaatctgcgtatgggcactccatagtgttgcgagtacgtctgacactgaacgctaccgtccttgccggcaatgatggctccgtccaccactaggccagtgacgggacacacccggcacggattcggtagactctcaccggtgtagttggctgcgatcgttttgtggtacctctgtttggacacagagccgggcactatgggctcggtggtcggtgtcatgttgtctatcgatttaatctgacacgttggcagtccgttgatgcgcataaactcgaaattgtcaccgcactcgcaaaccatttcggtgaggggtacattaatgtctacaaccttaccgttgcacacaaagggatcctcacacgagcccagcagacccagattgcccacgtagcccggctcggtacagacacacaatagattgtagaatatttgattttcatcctcgggctcgttgtaggcctcctcgtccaagtccctattgtacaagaccagtgccagtttgccgtgattgggattgcacaagtctacaacctttttcacactcagacaataaccgtcgtcgagggtcttgctcttggccagtttaaactcttgaccggtttcggtgtctgtgtagtcggtgtcctcctttaggtggacgcatcgtgcagtcagattcttacagcccatgcacgaagtggcatcggacaatttgcattctttaggtttactcggagtgcactcgtaaagattcgtctgacccggatctatgattacgggatctgtagaggggttcttgtatttaatgttttgaaaggggcctttaaaccttgttacagtgttgctgggttgtaaattagaatctttattagattccgtgtgcttggcctcgatttcgctaatcttgaatttataacggccccatgaaaacttttttgtttcatcattgtacttttcaaaactcttgcgtgcacactctagtaggtaggtcacgcacaccagtatgagtacgagcgatgcaatggtaaaaaactccattgaggcagcgtgcactggtggtgcgttcaagttttggtttgtgtaaaaaataagacttgaactcaaagagttgacttactaaaaaacaaggatttttattcatcaaaatactttataaaaatcttgcaatccataattgatacaaatgttaaactaaatctattagctatactaattgactctacattaattgtacgagtacactctacattaattgtacgagcaccctctacaatacttgtataattacatttccaatcaatccttatccttccaagttgcatgtgtcactgctcgcagacggtatgcaggaatcatagagattaccgcttcgattgatttatcattacccataaacagaggcggcatatcagactcgtagtaaatcaccacgttaatgtttaattttgcatacagcgatctcgcatacttgagcaggtttataaacaaaccgttgcgattgcgagtcatagtcttttcgtcaaacttgaacggtggcgtagagatccaagcgtaccggtgaatcttgtggccatagtacaattgcatgggattcgtcagagtgaaaccctctggcatgtttttgataaagagttgagcctctttggtcaactcttcaccggacaaaatcttgcaatccataatgctacaacaatggatgtcgctcagatggattgtagacaaacttgttttttgacaaatttatcctatttcgagccttggcactctcaatggcaatgttcaccaccgatagcgcaaaaatggtactaaacgatatccacacgttcatagttgcatctgcatgttgtttctgtaaagtatcgttgacgcataccgttaatagtctattgaaattaaacgcataacaagtattgtagtaataatcactagtaggtgtttaaatggagcatatataaactgaacaaattcattcaggttttatcaagcattcgcgttggtcgtgtgcactagtctttgtactagcctttgtttttattgcaacaatatgattcttacgattgtcggtgacgattctagcgtccgagtgtctacggacactttgactgcaaaggatgcgcactcgctcatggtgcaagagattgagtggaccatgaagcgcaaattggagtatccagagctgtcgctggagacggtgctctctgcgctgtatgctacgagaaactttttggacatgaatcacgcaccgattcggatgatggatcgcacctactacaatacaatggtggacttttccgatagttcggtgccggtcattgtgcgcaagactctgtacaatggggacaataacaacattgagtacgatgccaagattgtactgcaagaggacaaggacaatgtggacgagtacctcaagtgcagctacaaggtgtctcgagagatgaaactggccgagcccaccgaatcgatggtggtcaccaagaatgcaatcggctactactttatcaccgatggcaatgtgcgacacatgattcagtgtcagggtggcaggcactcgtacaagctggaacgagaggtggaatcggagatggagctggacggactcggtgcaaagattatcattcgtgaactgaatcggcatctggccatcggtaccgagtttttggaacgagcctacatggatcagccgttggatatacccgagtactatcgtgatgagattcgtgacattgtatctaaaaatgttgaaaattgtatatagtgtgttttgtaataaagtatacccgttgtattttttagacacatgcattgtacgacttttgatacatttattcatggatagcatcctagttgaaaagggtctagttttacacaagaagagaaaactcatcatgtcagccactcctagctcgtcaaaggtgcccagcgaaactcccgccaaggaagtgaccacaactacaatactgtcgcagttttgctatcctacgctcgtgattgtaccggtggccatatcaatcattatattgatatttgccgagcttacactgttttacaagattgccataatctgcctgctggcactgactctgtttatgtactttacgcagcagacaaattggaagctgttttgcaagactggaaagagtgcgtagaggtggaggaggatgatggttaaggggagtagggtggtagagtatgtggtagtgtagagtgcatggagtgtacgtgtaatggattgatttatggattttagatttggtctttagatttacattttaaatttacattttagatttgtctttagatttacattttagatttagatttattacattttagagttcttacattttagattatattgtactgtattacactgtaaacattttgtatttttgacagtagactctttgatagatggatagatagattacccacgacatagtttaacaatacttgacatattttaacaatactaaaactctttaataaatacctatacaaaagtagaatctgtttacttatttttgagacaacctcaccgaaccttgttttatttttttagcaatgcaaagcaccgacacggctttgtatttagtttgatattaaactagcactaaacttgtaaccttgtagactcgttactctatagagttgcctatacaaatcaaatggaactacaacaacaacaacatcacaaccaatcccagtattcccagcacacgtacgagcatcgagtcaggtacaatgaactcgtctcatcggtgggtgtgcatcccaccaattatgacatgtaccgattgagcaagactcgacactatgccataccgacgctggcactcaatcggctactggtgcgagtactggcccagagcagagccagcctagtaggcatcctgcaacgcttaaaagagtcgttgcacgaaacatcctccactctagagtacccactaaaagtatccaatctggcaaagtatacgagtgccgtgatccaagagattaccaacctccaccaagagactcctatacgtttgaatgaattggaattgtacaatctgtactcgtgccttgcaaacgtaactttggactcggacgaggatggcactgttcaaacatgctcctacaaaaacaagaatactacacctgccttttatgccgactcttgtacagacattgcactcaactatagattgccctatgtgtttgatgaaaagcacgatccggaatcgttgcacggtccctatctgacgctgaatccaaacgtgtccctagtcactgcagtggccggcgttagagccctgcccacggcaagtgcacgattcgtaatgttcaaggctgtgctgtacaagtgcattcaactggaccgacagactgcatcgattgacgatcgcattctctccaagtttgagtgcatcttggacgatgccaccgagagctacgattcagactacgtggacgcgttcctagacaatgcagatgctcagcagctagatcacggctactgttacggactgatgcgtgcgatcggcaccaatctgcccagagggcatcgtaccgagcgcaacgtcaactactctagccttttgtactttctgagcgtagactacaacagcgccttgctaaagtgcaaacccaaactcacccggtccgattgcgagtacattttcaaaaggatcgtcaagggagcgcccgagtccatggtgatcgataggtgtgcctataccgtgaatcagattgtaaagtgttttcccgatgtgggcacgtacagtgtacaagtgtacaattcccaagaggacaacaagagtttgaattttagagtcaacaaaaacactatacacttgctcaacgagaaccgagtgtttgaagatcgcaccaccgccaccgatgaagaggcgcgacccgatctggtgttgaatcacggttcgacgcacggtaccgttgtaacgtttggtgagcacgatgcagagttggacaagatatccagcgacgactattgtgccctgatggagtacgcccagacactggtcgagttgacgtttagatttggcaactttgaagtgctccagttggctctgcagctggcaccgtacaacatcaaagacgccaccaacgttcaattgaccatgactcgtaccaagggtgatatcgatgctgcactcgtactcaaaggactctgggaaactataatgggcaagagttgtgatctatcgtacctgtttaacattttgtgcaaaaagtacaaacgtacagaatttgatgaagtttccgctgccaatgaactcgtcaagtttgtactctttgactgtaatcgaatcaacaatctgccggtggatgtggaacaggcgaggtatgcctacgagtctatacgcggcaacacaccggacgtgacactctactatgcaaccttctttaggctcaaggaattggaactggtcaaactgtaccattcgacaccaccctctgagagagacgacgagtttatgactgtgctaaaggcactctatgtgacctcggtgcacacatcgcctctgggcaaacgtctagtgtgcttgttaaactttgacgaagacatgctacgattcgatgaatcgctcaaagcaaaactggccggtagactaccctttgcaataccgcacattgaggatgccggtgcactcttggaggttgatagtgatgctaacactactactatcaagactgatgatgatcaagctgcgctatatgtagacttttacagattcaccaatgtcgacaagagttcaatagagtcggagctcgagtaccgaatctatgcagactactacatcaagactagggatcagatggtggcacatttgttgtaggttagtttaggtgggttggattgtttaatgtagaggagagtggatgggatgagtggataggatgagtgggttggattgtttaaggtagcgatggatgttggttatagaggttcacgtttgtagagattaaaaaatattgttagagttttgtgttttattgataaccatacatgtacatttagaattacatttagaagtacatttaaaattacatgtaaacttatatttaaaattatatttaaaattatagttaaaaattatataaagacatactattgtatcaaaaaactacatttattcaagtaatactaatgttatagaatacatattacagaatacatattttttaaactcttattttatcaacaactctacaaatcttactacatacaactttagtacatacaatttttaatacatacgaatatcaatacatacaaatgcaactctgaatacaaaaaccctccatcctattcatcatcatcgtcctcgtcaaaggtaaagtcaaacatgctgcaatccaccttttgcactcgtagcgggtacagtttgattatgttttgatctccatactgagacgacaactgaggcgacaacattatggaatcaatcagaatggccacatttccagacttgcgaactccatcgtttaccatgaagccattcttggctcgctgataggcctgcagtgtttgaacctttttgtaggcacaaatcttgaccacgtccgatagacgcaaatctacaccggtcacttggttgtttacactggacacaatcatgtccctggcatcgccctccagtgttagaatctgcgccgatgccgcatcgtgcatcttggtaaagatgaacaagcgtttgccaaacttgaactgagcccccatgacgctaacgttggaaatgtcaaatttggacattttacactgcatcgatacaaacttgagattctcctcactgacacacgacaccttgccgcacgtctcgtccagtgtgccaaacgcatcgttgatcattttgagccaagcctctacgcgttctttgcgattcatctcggccatctgatccttgctgactttggactttttaccaaacctacccaggcagggacgtttaatgtctacgcgtaccgagtccccacagctgctggtcgcaatcgttataaactcttttagcttgagaatggcgtctgccgtgtagattgataaaaagtgcagacaccattcgataaactttaaatcacccgtattcgtaatcaagtcttcgtacagattcttgtagacatactctacggcatggtacagtaccttggtggcctttttgccctcgtcggtaaacaaatgctccacatccaactgatgcagagtctcgtgattgggatcgttcaattcaaacgagccctcctccttgataaactctaccagggcctttttgaaatcttccaattgcacaaacttgggtatgcgcttcacgtgcggcggtggctcgatgagtttaatgtttttggcaaaatctacagtttcggcagaggccgcagggaccgcatttgacgagtcccagaggctctcatcaaccttggccgagtctcccatgacactttgcaaatctacagatctcgcactgggcatcacgttgttacccatcatggcactggctggcctcttctgaggagccttgagtgcagattcaatgtttgtcttcatcatgatgaatacaaagttggtagtactagtttacttgatgctacaattctacgttagacaataccgttatagttgcaataccgtattgtactaaatgaaattttaaatacttcgatatttatatacactagtggtatacagccatgaatgcgtcactaagccggtctcagcgcgttatcgaaattgtacgtttactgcactcggtgcgtaaacgtgacattacacaagacgatgtagatcaattaaaggctctaatcaacactcccgacacgcgcatcaatagggccaattttgtacaagtggccaaactgtgcatcgtcaacggtcagcgtaacgtaaagggatgtcgcatgattacaaacggagtcaacgatttgccagacagtgttctaggattcattctaaacaaaccgatcgccttctttgaagactatccaccgtacgagaacgcgactccctccatgtcgattgcatgcctccgaaagaccaatgccgcgtaccactgtctaaactctagtcaaaaggtggcctttcagattatacacaaacagattagcgatagctttagattggacacggcatcctgcgtaccagagagtctagacggcaagtatacaccgcccaagattcactcgatagaagactcctttttcggtgtattaaactctagatcgggcacgggcaaatccacaattatgggtgtcatggcgtgttcgttgctcacacccatcatgtttgtagtttatagcaatgcgctcaaagacgatgcggccactctgcacacaaacattaatgctcgcaccacgtgcaattttattatgcacactctgggactctcgtacaaccaggccaagtgcatctttaacgcaccccagtcaaagacgatctgttccatattttacgatctactcaaattgctcaagacattcaagatggtgccgtgcaacgatggcgatttcgcgataccgtacctcattgtgtttgacgagtacacggtcatgcaaccgctaatgattatattcctgcacatgctcagtaggcagtataaactcaacattttgatggtgggcgatgccaatcaacaaaaggccatccgcacctcggtctatcacaaaatgaacaatatgcatctgctcaaggagctggcctcgttcgatctgatgctaaccaaacagatgcgcatcaccgatgccgactacttgaaaattatacaaaccatagagttgcacttggacgagaagcacgacaatatacgcatggatttccatgaaaagtatacactctactctttgctgtatagacactttcacattaacgagtgccagacggccatgtttctgacggccactcatcgcaagatgaaggatcggatacatagatgtttcaaggagagcgtcaaagagggtcgcaccatagtaaaggccgagtactgtagacgtaaagcgggaggctcctttgaagcggtagcgttgcctcaaaactacaagtttgcaccgctactcgtactcatacagggctactcgtacatcaagtacagcgagacttccaagtgtgaggacgtggtacagtttgtgcgtaaagtgtcgcctacactcattgaggtggtaaactctagcggtcgtttggagcacttgcaacgcatcgcagtaaacgcctacaataccattgatgatttacgagtgtggctaacgtcgcagggtgctcgctaccagtacccgttgcgattctttaccaacacctactatagcgctcagggattgactctggacaagtgtgacatggaactggacttggacgacaccaccatgaatgcagtctacgtgggcctgactcgtatccgagagggattccgactgaagcgattacacaccaacgacttgtgcagtttagtgtacacgcacgtcaaaaacgacgagtactactacaaggtacccgaagtgcccaatctgtgtgaaaagtacaaaatcaccacggacgatttgaatcagagaatcatttcggtaaactctgtgctggcctatctgtacaagacggtaacgtttccagtggtgacgcctgaagcttttcgcgtatcaaagggccgatgcgtacgagtgctcagaactacgtacaaggagtatgtagactctttgcagacaaacacttcaccgttgctagattgctacaaacacatcaaggatagtgtcaactttaatggcctcaccagcaagagccgccgagagctgcacgatacgatacagtgtccgtgcacgttcaaagaggagcctcaggatcggttggatgaaaaggccaagactgatcccgacgaggtggtgtgctacgacgacgaaggtaacgagtgcattttacaatacgtaaagagtacagctcagaaggagcctttaaaggctggctccaagaggaaggttagtggtaaaggtgttgtcaataaaatggatttggagttggaactagagttggcgtcaacagtggagcctgaaccagagcaacactcggcatctacagcgcaacctgaagagtacggtactggtgccaatttcaagtcggcagagtttgtaatgttcgactcggcctctagttcagattcagattctcagccagagagcaaacgttgcaagcttgaggagttgcaacaagtgtctaccgagtgcgttgcatcaaacataccagtaggcgttgatagggtttgtgtaggaggaaccgattcagacctcacagattcagatgttgaagtgttggatagtgtggctttggattttgaaaaggagttttagatgtaggtgttgatgtaattgtaaatgtaaatgtagtttcaaagaatactcatagaccaagttgtatcaaatgtattgcatgttagtaaaaggtattgtatgttatgtagatgttgtttattaagtattgttttttattataatatttattaagtattgttttttattataatatttattaagtattgttttttattatttaaaaaatatcaaatcaagtacaataccaaagtatactactaacaccatctacacaagacacaaacctactctatgaaaactctactgcgcaaactctatgctccatttacaactcagttcaagttcaagatcacaacctccattacacatacacgagttcgttggcctgtaaacggtttacaatctgtgccaagtttaaactgttgtactctgtgtagacaacaaaggtttgtgccttttggtttctttcatacattgtacccgtgtgcgcaaaactatgcatttaaaggtaggcgccaagttgtgtgtttaagagtagctttataagagtcaggggattatatttgattttagggttcactgtatgcaacaaggataaggtttaaatcaaagagtccatcttgagaggtttcatcatttatttagagtttcaactcagtcttagatttaaagtcataatttgtactagttggtagattgtatgtttgtagattataatttgtagattgtgagttatacatacaagtggtaaaatgcaagtagtaatttaggttagtgttaagtatacatgtccaagtagagtgtctaaaaaaagaatacttaatgctagtatatacaatggtttaattaatattcattggtatatatcacagacttggtgtactacacttggtgtactatacttgtatactagatgctataatattacactgtacacattttaaaaatatagagtattttttaatatacctttatttatttttaatcattttatatttaataatacaacttatattctaaggataaattgaagcttatactctagggatacattgatgtttataatctatggatacatggaaacttatactctaggaggttacattgacttttattctaaagatatattgaactgtatattctaaggatacattgaaacttataccaacttatactctagggatacaagattgaatacaagactaaatacaagatcaactacaagatttaaattacatccaagtatgaatcaaaactccaaatcaaaaaccaactctaattctcatcactgctaaaatcatcattctcaatcaactctcgagactttatcctgctagggtcaatctttgacgatgcactagatttacgtgaaccattacttgtacgctttttgggagcactgttagaagggttggagctgttgttgttagtagggttagtggtgttagtactgttagcattgttagtggggttagtattgttagtagtattgttagttgtgtcagtattgttagtactcttggcactgttagtattggaatcggtattgttagtgggagtagggttagagttagagttaggattcgagttaaggttagagttagtgttagagttaaggttacctctatttgccgcattagcctccatacgtctctgttcgagccttctaattttaacgactcgactcatcggaaagtatccaccctcgatcatatcgtctctctttggtttggtgacagccggtgtagtgggcttgtttgccagaggcgtacttgccataggtgcacttgccataaccttgttggccatagccttgttggccagagaactctgtaccggtgcactctttaccggactcggtgacctactggcaacagactcgttgtcgctgctatcgcaacgttgcctcttactgggcacctctttggtggctctgtttgctttgcgtttcgtaccggcactgctagtgctgcgctttacatcgcactgctcaaacaagtcatcggcctgtcggtccagattcacatcggtatgattggcatagtccttgaaggggaaccatgtacaattgttaatcacaatggccatgcactgtctaaagttgctgggcttaccagaggccctcttttcctccatcttacacagagccatatacgatgccattatgtacttgatgtaaaactctttgatgactttgaaatagtcactgctgggcttaaagtagaatagaaactttacccacaagtttttcaactccccattaaactcgtccatcaagacatccatcacttggtccaccgatgtaatattgttcaaatccaacacattgcgacaaatgattacattcagtttaccatcggatggagtcttgatggtaccgtgctctggcatcggatacgactctttgtcgtggttcattgcatactgcagtgcgagcaccgaagctatattggctctggtgactcggcacgatctcttgttgaccatcgtggccagtacagacagtgtgatgagggtaatgtaattctccaaagatctagctatgcacgtcaaatcgccatcgtcaacttgcatcttgccaattgacgagattgcattctgcacatcggcattggtaatcttgttgggtagagaacccttcgagtctacacgattgccagtaaagatgcgctccatctttttgctaaacattttcaacttgggacacgtgtaagagtactcggccagcttcatttgtttgtatgcgcgcagaaactttatgcgcaactttagcttgccgctaagctccttgtccatagacttgtcctttagctgattttgaatactggcaatctgtttggataggctctgacgcacgtttgccgtttcacgcttaaactcggcagcggtgcaattcgtctcattgtgatactgtgcataggcaagttcgctaaccttgcaagcatacgtttcgtgcaactctatcggatgcttgtgcgtatcgatggcgttcaacttgtgcatgtgtttaaaacccggctctaccactttaaactcatcgtacaaggcctgcttgtcggcactgttactagtcaacggcactggcacacccagcggtgtactcggcagcttccttttcttttcgggtgcctcagacttgttctctggctcagagcatgcactagattcggaacttgtacgcttcttgccacgtttgggggctgcactctttttaggcttgcacgtgtgctttgacagattgcgtgcagtcttgtaggttttgttgcactgcttgcaagtcaaagcggcacgttcaatggccaagattgtagcctcgtcagtgcgtctgggtggattcattttgagtttgagttcatgcatacgatcagagactttggtgttggcgtgattgattagagtgggacgtttggtaggagcggttgaggattgcgtattaggttgtgtgttggactgcgtgttagattgagtattaatttgatcattagcttgagtatcaatttgatcattaacttgaacattggattgaacattggattgagtattgttgtttgattgagtattgtcgtttgattgagcgtttacatttactacagttgattgagaattggatgaagagttgttggatgaggaatcgttggaggtggactcgttggattgtgaagattgggagttttgattgttggattgagaagatgtttgattgttagatgtttgattgttagattgggagtttgatgcaagagttttagtaggtacaggagtaggtgtaggttttgcaacctttggtttaatggtcttttcagatgacgagttgttagctttagatttggatgcacttttagagttggagttgttgactttagagtttaccgagcctccttttacagagcctcctttagcactaccattcttaaccgagtttttagcactgccatttgcattcaacaaagagccccctttggtagaattccccttattggcatcggtcaactctaaattcaactgcaacgatttaagccgatcatcgagattcttgcctacagcaatagtggacttggtctttgatttcctactctgagatgcactagtaccactcttgacactggcattgtcatcctcatcaaaattgtacacatcaatattggacttggccgagcccaatgctaccgtttcaatgttggactctttaccggaaggagcaagattctccttgttaaaatcaccctctacaccaacattttcaacaatagtattggactcgtaatcgacatcatttacattagaaccatctacattagaaccatcaacattggactcgttagcattaacctcagtattggcattctccccattaccctcattgttaacctcatcgtcctcctcctcagcctcatcatccgatctattaccacctcggctactagccctactgctagatctactattggctctgctactagccctgctactaaccctgctactagatctactattggcctcgctagctctactacctttgcctccactacctctaccactattcacactacggttaaaactatttctagacaactcacgattgttgcactcgtcgtcttcatcgctggcatcctgagaatcgtcacgcctactctgcaccttgggttttcgcttgtggtgcggagtctgcggacgactgcgcctaaccggaacagagggctcctcctgactactctccgcctgagccttcttggtgatgttgtcaagcttgttgaaaacgtgctcgttcaagaacttaaagttttccatctcatcgtcaacctgacgcctacgcttggcctcggactcggagtcggtggcgtccaggatgccacgtttacgattgtgttcggttacacactttgcggccttgcgcaagagctgctccccgtccaccttgatgcccgaatagtccgagtcggcatcgctgtccgattccaaagaggctcgcttggcacgattgcgctgcctctcgatatcggtgttgtcggtgtcggcgagttcgacatccgtatcgacacccacctcggcaacctttcgagccatcagctcttggtaatcgaaaaacggcttatgcggctcggtaccgtaggggttctcggccgaggtacggggattcttcaaacgaggcaaatccatcttgatttgaggagtcccatactcgatgatattaaaggacatgtgagaggacgcggacgaagccatgcttatatcacagcaaagtgacctgctcaactgttaaactgcaaataaaattaaccgccataagttattgtatttatactaccgtctaatctagtacaataacgcacttttcgatgctagttttttcaaacaccatttttgatactctcctttatgagatcggtaacgttttgaatgagcacatcgtcgcccatatccgatgtttggaaggaccgaatcgttgcgagtgccatgattgtgatcgagccaaataccacaatcagaatctttgcgtacactttgcgcagagccatgcactcgggcgatttcggtgagcacagactactggcggactcgtctatcggaatcgttgtactattattgcggacgggctccatttcgatctgggtgactccccgtctccaccatcgcctcggtggactcggatcctctttgggtttgacatcaatcacagaggacgcatccgagccatcggtcagagtaccatcatcggactcgtaggatggatccgattcagagtccgagtcctttgcgaccggggcatctgcgggttttgatttcagagtttctgtactggtggtgctcattgtgctctcagtttcagtgtcggtatccaacgagtccactttcatgatttcaaccttaaagacgcccgatggagttttgtgagtgcgcatcatctattgcacaacaataccactgtaggaacatgaaatcattgaatgttaaagagccaactccaatagcgtattagaggtgtggttaaaaaaagaaaaacctaaaatttacattattcaagagtacatgaatgtcttacaaactacattagactacccggattgacttgctcaaagatggcatgtgtgaaaatcttttgcatagagtcaaaggtgtaggttgcatagtgcttgccgtttaggggctcaatcagattattataacactcgacgacaaactggtgaaacttttcaaattgctcaacatcgtttgctacatttttacgcatctcatggatgcatctaagattctgacggatcctgaccgcatcggacatgttgtaaaagagcatgtacggaaacaggttgacgttgtacttggcgttctcctcgttgaatgccgcctccaagtgtttgattttggccaaatcgttttcagaattgatgctcttcagttcgggatatttaatcttgagatcgttgtacatgccgctggccacctgattggcgccgtcaatgaacagcaccttggagcatcggtcgtagatgagactctcgatggcgatgccgatttcgtgtattatcaaatcctgcacattgcggtactcgacaaaggtgtgcgagtgcagcaaacacagagtgcccacaatgtttaggaacacgtcaaacattagactcagactgcgatggttgacaaactctggcttgaacgtgatggcacacacaatgtactgtcggatggcggtgagtttctgtgaaatgttgctgtactcatccgtcatgcgcaggctctgcacgttgccatacgtcaggtaggttacgagctgagagttggtcagtttgttcatgagtccggcgaccgtcttcattagcgattgtatttgcgcgtacgagttttgatcgatggcattgttgggatcgttgttggaattgaccattgcgttcaagtggttcataatgtcctctagggcagccttgcacgtcttggtcaccggtaggccaatgttgacgatgggcaccaggttggcaaaacactgagccagctccagggccatactcttgcgcatgattgaaaacgtttccgtgtacacatcggacacttgaaagttgttgtgtttgcgcagaggcagagtgttgaggtagacgacgtagggttctccattgtagagaaactccaagtcgccattgacctcgtacggtacattgtcaatcactacgcaattctgttgctggttcagttgaatgtttgcaaacatgattcccaaaaacaagagcactgcctacctatctagctgccagagtaccagtggtcgagtcacagtttacagtgggacaattactagaactagtatttgaaaagtacaagaatatgacaataaacgaatcacaaatggcctttaaaacagtcaacaaaactacaaagactcccgtattagaaccgaccgaaaccatcgtcatactataacaatgcacaagtttaataacaccaatagcctattgtgactatgtttacactacctgtacggtaatttcagtttttcaacgtgtctctatcttgcataggctattgtgtgtgtgccttgtatgcgataaagtttacgattgctattgtgcagtattgcaatgttgagggtcgtctaccgatgcatgatgcgacacaatctgattgatgagtttgcgcacaccgatttcaatcaatttattggtgattcaaacattgagctattgcaacttttgacttttagactgttggcttacgatcatcaagaggacgatttgtcaatcattctagactattacaaaaacattgagagcgacggtaagaagagaatcgaaagcaccgataccgacagcgagtacagtgtagactcggactcttcggaatcggacacaggagtaagaggcagcgtaccggtaaacgaaaacgagcaagagttgggttgcgggtgcaagaggcgttgagtgggagggaggaggctatatctttttagtgtaggagttttcaagagttttattttaatttactaatagtaggattactagtagtattagtagtagtattagtagtagaattagtagtagtaggattgggtactagtttggcatcaaaatgaacggtagcttcatctcggaactctatcgcaataccaaacccattaccaactctgaaatgacagagcccagtaccgttgcagaggccatcaaactgtacactaaaaaggccatgctcggaagctcaaagagtactgttgatgacaatgttaaaagtgccaacattgtcaagagcgctaaaatcaatggtagttttaaaagtaccgattctagtactctggaagctaccagtgctggcattgtccaatttacacacaatcaacacgtacaagatgcgggcactctacaacctctgcacaaaccgtgcatactcatggtagagtacccgtacacgattcgatccacgtacgcgtctctggatcacgatctggtgattgtggacagtgatttgcagcatttgcgcatcaacattctacacattgaacagccgctcataatcgacgacattgaggatcatctagtggtcgacgcggaccgcatctcttggtcgtacgatgaagagctactcgaggatgagactgtgcaaacgtttagatactatgctgccgtacagttggatcactaccacaatgaaatgcatgaattgcgacagattgccgacacgctgtaccagcactcgaaatcgctactgaccctcagacccacaacgattcgctccaagctcaatctgggcacgtacactcggtgtccaccgaatgcgtttccgtgctccatagtttgggccgaatcggtgaccgtctcgaatcccggctttaatctggtgctcatgtccaaggtgccggcaatcagcaattccaaaaacgatccctacaacagtctgatgagcgtcaacctgactggggtgcctatgcaagtggaaaagtttacagagcgctgcatcaatcactatacgtgcatgatgcacaacgccgacgacgatgccaatctggcagtgtttcagcactcggccggtgagagtagcaactttagcactgtcctggagggcatgtctcagactagacccgatgccactcgctacctgtccacgttcttttctacgctatcggacaagtgtttcgattgcgtctacgaaatgacaagatcctgtgtgcgtctaaatgcacgcaaatggatacacattgatcgaggagtgccctatacgattctgctcagacgcagtggtataccgcaccccagtgcacccagtgcacccagtgtgtccaatctggtcgagactgtacatctggtggacacggaacgatgcatcgattcctacattgcaacctttcatcgtatgaaattctacaagattgagattcacccattcggtttgtattccatggatgaaatgggcaacattatgtatgtgggtgtagtggataaagtgtttaccctatctggcttataaactagtgtatagttgtagaaatccaattactttttggtatctagtatacaggctgacagagcccaccaaccatcatgggtatcctaaagtttaacaacgttttcaagcagtacattgtcgactcgtacgacacacccgatcccagcctagagtatactgtacatgtggatggcaatttgaccctcttcaagggtgtcatcaacggatgcgtagatgcacacactatagccaacaatgcgttggatctgctcaaagcaatgatgtaccgattgagtgtcaagatttcagaaattgtaatctatttcgatggcttgcctcctacgcgcaaacatgacacttcaaagaagcgtgccgtaaatttaaagtttaacgcacaggcagcgcttcagtactacaaggccatgctcgaggaagagtcttggttccgagtggtacagttggaggtgggcgaaagcgaaatgcaaatgatactggatcgcgatcccaccaagcccaccatactcgtgaccaacgacagtgacgtttaccacattgcatacggtcggtacgacgatgaggctcccctgtacctgttgctcaatggcggtgaacgattcgtgaatctgcaaaagtttaacgtgtgcggtatgcctaggaatgtgttttcggcaatcgttataatgatgggtaccgattacactcaaccgttgctaacaccgtccatggtttcggccatttgtcagtgctacatgatgaggcatcaggatgccactctgttgaacgcctttgatagcataaccaacgattccctgtcaaaggccaaacactggcgtaccgtactgtacgaagtgtgcaaggtaatctttcatgccaagaatcagcactcgatacgcattcactttggctccaaggtgatggacaagcgcaccgccaacaaggacaatcccaagttgacttgggcagaaaactgcaccgtagaacgttgggtggaatcgttggcctggtgttcgcgctactacgaacacggcaaccgtgtggatcgatactcgaataatgaacagtgctttgagtttatagagcccacatcacagtggcgtctaatgaagggggccaagagtttcggaatgggtgatttgacgtcttggcgtgaaggctgcgagatgcaagttgacgaggtgcagagaggtaaacagttgcaaaaattgcaaatgtctgaggttagaggggactcgaagagagattataaaggatgctcaaagggggattctatagtagattctaaagcagagtccagagtagattctattggatgtgatagagtagattcgaatacatcaacaggtaacgagtataaagagtctaaagaacacaaaaattccaacaaagacgagtcaaaacacattccatcaaaagagtcgaatcactcggaaattaaagaatcctctgaggataaatccgagtgcacttctgaggccaactctgagtccaactctgaggataaagccacttcaaaggatgagagcaaagagccgtccaatgactctaatgaagcatctaaatcaaactcgaaagaaacatccaagtcaaccctagactcggaatctgaatctgtcacatcgaccagtacagattacacgatcaaatctagcaccatagaatcgtactcggaagagttttcatttgaccgttccgagtctgaatctgatccgtccatcagtctgttggaacgagtcagggccagggatcgcgcactcgtcaaacctaaacgcatacgaaactttgtactgtttcaattcaaagactcgttgatcagaccagacaaggcaatggtacaacctagcctgtttggattcaagcccatacaacaagatgatccgtctgtggaggactcggatccagccctcgaagagcccatagactttgagtccatcgagaatgaagtgtcaccatcaaagattgccaagacgagcaacgatgagtttgaaccggtcagtagcagcagtggcagtagtcttcagttggactcggatgatagcatgtctatattgttgtaggatgtttgctgttgatgttagtggttaggtttatgcttagtcttgtgtttagccttgtgtttagattttacatttacgattatttagagttctatatgtttgttttgtattcatcagagtttatagagtagagtttatagagtagagttatatatatgtataaatataaatgttgaataaagagtgtaatgattctatttttttcatcaaaagattcttcttgttttttaatcaaacatctactcttgttttttaatcaaacatctactcttgtttttttaacccaacatctactcttgtttttttaacccaacatccactcttgttctttaaaccccttgatagtactggtactcttccgagtttaaaacatagagtactggttaatgtctccatttgtttgaaatcctatttactctagagtgaatcgtttatggctacactttgatggaatcgggtcaggttaatgaaatggactcgtaaactctttgattggctctatattgaaaatcaatattgaaaatcaatgagtctaggggatttggtgattcagtgtatggttgagtgcagtgcatggttgatgcatctcaaattgaaatggtataatgttgtgagctctgagaacaactaatcaagagcacacaccggaaattgtcatttaattaaattgatcaacattaatcattcaattaaaatgtaattaattacgcaactatatgacacatttattgataatacggtattggtggtataaatggggcaacattagtagaacaattgcacaagtgatccagctctcttagcttcatcttgtctgctctgaatccaaatcattaaaatgtctgccccagtcctcaagtaccgtaaactgagcaagaacgccaagatgccgatccactctaccgaagagtctgccggattcgatctgtgcagcgctcacgaggtcgtcattcctaaacggtcgagggtgctcgtcaacaccgacctcggcgtactgatcccggaaggttgctacggtaggattgctccgcgatccaaactggcagccaagtacggaatcgacgtcggagccggtgtcgtggaccgcgactatactggaaacattggagtggtgctctttaaccattccgatgacgactttgtagtgtcaaagggtgatcgcatcgcacaactgatttgtgagcgtatagagattccgacccttgaagaggacgacaccatcagtgaacgtgtaactgaacgcggcactcgtggtgttcaaatgtgcattggcgatcccatagatgttgccattccaccggctcacattctaaacattatgaacgatgaaatggaaggtttagagtcacatcaaaagtggatcaaagccatcgacactgtaatggaggcggtgaccgatgagaatctggccgaagagtttgtggccaacttgcacgactctatattcacagagtgtgacgatccggtgagctatgaagacatgctgaccaaattgtatgcagtgttttcaagcaacgagtccaagtatcccggtgacgttgcctacattgatgctctgcacgagaaaatgtacccgacaaaggaggctgtcgccgagcgtacagatggccagttttcatcatccaaccacttgtttgtcaaccaaaagatttgcaacattctaacgtacctcatgagctctaccgagtacgatcacgtcaaggaggtggatgagagcaagctactcaatgcagtgtttgacaacttgcaggccaactttgaagcacaaaagaagcggccctttcttgaccgtctgatggacgcagtacgcctagtcaaggtgggaccgttcaacactctgttcaaggaggtgtctgaagctatggatgcaaaagctgagaaggagtgttgagagttcagaggtggtggtgtagagtgatggtgtttagaattaagagtattgtaaaccagtgtctaaattgtaggattaagttgtagtattaagttgaatatgtatcattgttgaataaataaaggtttctttttttggtatttaaattgtttgattttttagagacttgtactatgcaagtaggtttggttgggtaaagagatggttcaagttcacttgtaatattttaggtgcagagagatggttcaagtccacttggtatgctaaagttacaagcaccaaaacacagagttgtccaattcacaagtaatggtatgctaaagttacaagcaccaaaacacagagttgtaaatgctttaatttttttcatcaaatcatttacatgttgtttaaaaaactaaaactagtaaccccttgtaagatggtcctcagaggtatcaagtctcgacacacgagtaccattcagtcacgagtaccattcagtcaacccgagcaccattcagtcaacagtgcatttcaaacagtctcagtgtagtgtctttgactttgacaatgtgcattcctaaacattgggcctttgtttgaacctttgtgttttgcacatgcattgtatggaaattgacatttgttgctaaagactagtagcaggcgtttagagtagttggaggatgctagaggcaggtgcttaaagccatctctctgtatgcatgtgtgtgtacattttaaaagtattgtcttttaaagacatgtgtgtatgtagaaatgtgtagagttgaatggatgcattctctttgcatttaaaggtatagtgtctaaaaaactagaatcatttattgactaaaaaacaaaactttatttaataaacttttacaaaacacggtacactacaaggtactctacaaaagtaaaaggtacaaggtactctacaaggtacaatacaaaagtctataacagcatcttataatctacaacattattcaactttggtatacaaactgagcattagagtattttgtaaaacattttaattaagagtattttacattacattcagtctacattaaaatcttagtctattcttataatcttaaaatcttggtctactttagtctttatcatcctcactcgcccgctggtacaacatccaccaccacttgaccgttggagagtctcttgtacgacgctcgttccggctgagttgcattgtctggaatcacagtgtatctaaacgtgtcgacagtgtcaatcatgcgcagcaacgagtagtcaaacgctccatcggccatggctgcgttcattgaagtgttgtagtctgaggccgtcaagtgtccgtacatgtgttgcatctggcaaatgtgcggatggtctctaggacagttggcccagaacacgctagagtcgtacgggtcggcgttctttaccgacattttgtattcatcaaactcgtagaagcccctgtctttgaagaagtacactttaccgttcagccaggacatggcggcatcgaccggtgtctgtaggttgcggaaatagttggcaatgaggtaggtctttgttgcaatcctgtccttcttttcatcaaacaaccagtatttgtcaccgctcagtatgaacgtcttgttgtgccatctaaaggcagtgtcaatctttgagccttcgatgcccatgtcggaaagcttctttggatacccttgcgcaacatcattgcccgaaaagacgtacattagatcattgatgaacatggccactttaccatctttgcgaatgtagatggcgtctagcttttcaaagtctggcaaatggtacactttgttgattggatagactgatatagtcttgggattaaacgagcccatacgccaaacaaacggtcccttgaacacgtacacttcaccaaacatgttggccacactatcatacttgggcaaatcacaaatgtagggattgccaagtttggatttgtacgtttccgtcttgggtcgctgtggcggtggtggcggtggtgttgttactggtgtcggtggtggtcttgtcactggtgtcggttctgttaccggtgctgcagcagcctctttgtacgattccttttctcgtttgtcactgggattggtgtgagtaccatttctgttgccgtacaaggctttgattgccgcaatgtcatcctctttgagttcacgcttgacaccaccatagtatggatacattacggcatcgtgaacatcactgtgacccacacccaatgcatgaccgagttcgtgcaacgctatcgattggaagtcggccgactcctcgggtttgcgctcctcagcgttattcgaaaagacccatggctcttcggcgtcaatgtgaatctgaccacctctgccgggtcccggatagaaggcgtgtgccaagaaccatccgttgccatcgaatcgtgtaccgtctccgtgatcgccatgataaaagcccagtgtaatggtagacttggaaccgggggcgacctctacaaactccaaggcgggagcctctcgcttccaccgtttgagcattctatcaacatcggtacggataacgtttatattttcaatattcgaagagttggccaaaacactccaagttatcggattcttccatgtgtcgtggagtgtgtatcgttttgcgcgcttgggtgaaatgtctggcatcgcacaccgcttagtgttcatctttgtcttggtgtgcggatccatgtcaccggtgattggtatgtttgcatacgattggaatcgttctagtgcaccgactaccggttgcatggcaggctcctctagtgacagtttaccatcggtcaacctaagatgcgcgcctaccataaagtcttgcagatagcccaagaatttgagtttctccaattcctcgggcgtaatgaatttggactcgtctttggtgttgtatcgtttgcgaatactctcaggttgctcattgtcagaatcggccacattgaacgggttcattggattgaatctagacatggcatccatctcggaatcttcattcgactcgggtatttcatcaaccctatcaaacggattcatttgctgagcctgttgttgttgttgcggttgttggtattcgtcaatgtactcatcgggaatctgaaactgatcttgatctaccgcattgaatggattctgtctattgtatgcgtgaatttcagcaagatcagattcatgatcggcataggttggattggatgtaggagcaagtctgggtaatgtaggtaagtgtttacgaaccggtctaactgtagcatgaatgcgcttgttgacgttaactcttgtattgaacgagttgtcatcgtatagattgtcatagcgttcattttctagacgcatggttggtgcatgtttaggattaactctaaagtcagagaggtagctaaaatcatagtttctacgatcgggtagtgtattgtatttatcaaatgcacccgcaccataccaaaagagtgccagtgctaaaatgttggcacccttcatacttgtaaatgtacctatagagctaaagatgcaaatgagtaaagacacgcaagagagagaggaaaagagactaacaaaggacgctcgcctacataatcaaaaaaatagacgattattggtgtaaatattctttattaagacttgtaatacatgttgggacaaagcacacggttaaatgtatagattacaatttttagagtacacttgcaaatcacacaaattccctatcctcgctacaaattttggcatacacatctctagcgtccctagcaaacctggcatactcttgggcagtgtccttggcgtactcttgcgagctatagctcttgacaaagccttcaatgatgcgaatcgtacccttgatggattccgagtttgcatccaccaccaacactggtgccgggatcggtttcttgccatgaatgagccagtcttcgtgcaactcgtgcaacttctccaagtagggcaactctatgtgggactcttccatgcgacctcggcgaatcgtgcgctccattgcaaccgagggatcggtgcgcatgtacacaatgagatcgatccgcacactgtctatcaacacttcacacagactcttgagcacgtccgcattcaagagtgccatcgagtctgcatcggtgggatcactcttgtccatgatcgatgatgcaacggcctctataaagcaattttgaacactgagcaaggagcgctccataatcttgaaaggagtccgcaccggtcgagtgtgagcctcaaacattgtagtgcatatatacgtttgaaaggccgcaaaccatttgactggatcgagtcccatgccgtgcaacaggttataccctttaaagtttgtccattgatgcaacggctcctctatggcggtgaaagagtccaagtttttaaagtgattcaagagggccgatttgccacaagcaatattgccctcgatgaggatgttgaaggatttgctcacaccactgcgagcaaggtccgtagtgcagttggagggcacggtaaaaagtgaacgaacaccggccatgatttattgcaagactgctaaagtcgacgtctagtttaccacaataccgtatttacactatggcgtgcaaacttgcgcacaactaaagtcagaatgcgaaaagtgaacaaatccgctcaatattaacactaatacgctattggtgttatatcggtgtcgactctcttagaaacgagcaaaatgtttcagctttgaaaaggttgaaaaggcgttttctatgcaaatcgttctagttttttagaccgagtctctcaaggttatgcatggactcgggactcttttgtgcaagttttgtttgaaattgtgcattttagctctttgatgatagaggtggagtttgtcttttgattttgagttttttagactcgttgtttggaatcggttcgtagaggtggaggtagagtttggctattgagtttgagttttttagactcgttgtttggaatcgttagtgatagagtttgtctttggagtttgagttttttagactcgttgtttagactcggtatttggactcggtagggtgactctttgatggtagagtttgacttgataattctagttttttagactcgttgtttggactcggcagtgtgactctttgatgatggtgtttgtctttagagtttgagttttttagactcgttagagtgaatcgttaatgtcagagtttgactttatgattctagttttttagactcgttacttggaggactctgatgctagagtttgactttataattctagttttttagactcggtaaatggaatcgttagggtgcccctttgacttggtagttttagttttttagactcgttaaatggaatcgttgttgtccgagtttgtctttcatgttctagttttttagactcgttaaagggaatcgttgttgtccgagtttgtctttcatgttctagttttttagactcgtcaaaggggactcgtcaagttgctctcagagttgtgtttcaagttttaattttttagactcgtcaaatagactcgttaaaggggactcgttaaaggggactcgtcaagtagactcgttgctctaaacaataccagtaatgaatctctacgaaaccgatcccgagctgtatgcgctcgtagagcaagaggccgatcggcaacgggcaggcttagagttgatcgcatcggaaaactttaccactctaccggtgcgagaatgcatgagttcgtgtctcatcaacaagtactcggagggtaggcccggaaagcgatactatggcggtaacgagtttatcgatcgcatcgaactgctagcacagcagcgatgtctcagagcgttcaatttgaacgagtccgaatggggagtgtgtgtacaaccgtactcgggctcgatggccaactttgccgtgtacactggaatcgttaaaccgcacggtagaatcatgggactcgatctgcccgacggaggccacctgacgcacggattccgcaacgtgtccgctacatcgctctttttcgaaagcatgccgtacaaggtggatcctcagactggactcgtcgactatgccaaacttgccgagagtgccaatctattcaaacctaggctaatcatagccggtaccagttgctatcctcggcgcttggactatagacgattccgagagattgccgatgcagccggctccttgctgatggccgatattgcacacattgcgggcttgattgcgggcaaagtcattcctggcccctttgagtattgtgacattgtaaccactacaacgcacaagactctcagaggccctagagccggagtaatcttttaccgcaaatcactagagcaggaaattgaacgagccgtgtttcctggactgcaaggtggaccgcacaatcacacgattgcagcgatcgccaccgcaatgcaccaggccaccactctagagtttgcactctaccaaagacgagtggtgcgaaatgcacagttgttggcagagggactcgtttcacgaggctacaccgtcaccactggcggtaccgatgtacatctgattctagtggatttgcgcagtgtgggactcgcaggagcaccggcagagcgcatcctcgaactgtgcagaatcgcttgcaacaaaaacacagtgcccggagacaagagcgctctcagaccaagcggcatcagactcggtactcctgcggtgacgacccgtggtgtcaaagagtgtgacattgaacgcatcgtagactacattgattgtgctctgaaattggctcgagagattgtacgagtgtcgggaggagtgctcgatttggactcgttcaacaagacgatagaatgtagtgcagagtttaagagtcaaattgaaagcatccgaaacgatgttgaatcctttagtaggagccttgactctaacgttgacttgtgttagatgtgtgatttgctataatgttgaatgtaggagtttttaatattacaacagattacaacttaatgtttgaataatgttgtacattgctataatgttaactttaggagttttgattttacttgtacatgtttgaatgatgttgtgcgttgctataatgttaactgtaggagttttgatactacttgcaacttgctatacttttaaatgtaggagtgtaaaaaatatatgtataaataaatgtttgattaaaaaacaaaagttttattttttaaacatatgaatatttattgtatgaaaaaatacagagtatactatgctaaaacttgtgttgaagcttgtactaaaacttgtattgaagcttgtattgaaacttgtgctaaaactcgtctaaaaaactaaactctaaaaaactaaactctaaactatactaaattacaattctatataattttatacaattctatacaaccaaatccatacagtcaagtagactctatacatataattctacatttaaaactagtacatctttctataccacaaccaccaccaataccaacaccaataccaaaaccaacaccgctaacactaccaccaccatcaacactaacaacatctctctaaaaatcctcactaatcttaaacacattatcctccaaattgacaccgacaccgtagcgtttgtactcgctgaccttcttctcgaaaaagttggtcttgccctctagtgatatgctggtcatgaaatcaaagggattcttggcgttgtaaatcttgcggccaatcaactcgtacagtagacgatctgccacaaactctatgtactcgcacattagcttacagttcataccaatcatgctgaccggtagggattcggttagaaactcttgttctatcctcacggcatcggttacaatgttgatgaccttttcatcgctggatctgcactcgggacgcagatagttgcgaaacagtagaatggcaaagtcacagtgtaggccctcgtctcgagatataaactcgttactgtgcgtcagtccgggcatgagtccgcgcttcttgagccaaaagatggccgcaaaactacccgaaaagaagatgccctctacggcggcgaatgccaccagtctgtcggcgtacgaagacttgtcgtcatcgatccaccgaatcacccattgagcctttttacgtatagacggcaccgtgtcgattgcgttaaagagcatgtgtttacgttgcggatcgcgaatgtacatgtcaatcagggtagagtacatttccgagtgcacattctcaatcatgatttggaatccgtaaaagcacgacacctctggaatggtcaactcttgagagaatcgcgtcaacagattgtcgttgacgattccatcggagccggcaaagaaggccaaaatgtgcgatataaactctcgctcagtttcagtcaaacgagtctcccaatcgtacaggtccttggacagatcgacctcttcgaccgtccaaaaggaggcctgagcctttttgtacatttcccaaatgtcatgatacctgatgggaaacagggtaaatctactgctgggctcttcgaggttaaactcggaaatgcacgaagtctgaccgtccatgattagtattagcggtttctcccaaatctactattgtgtgtgatggaatagagacaatagcctattgttgttgtattcaaagtcaagtacatagtttaagctagtttatattacaacaagagtagcatatcataccaacgactctttggtggtttctttgatagaccagtgtagcaagcgatcgcaaccaccacaatcaccacaatcacatagaccaccgtgatgagtgtagtgctcacaccggtcaagagtacattggacgcatagtacgtgtcctttttgaggagtcgttcaaacgtctctagactgttgaccgatgccggtgccgagagtagagccccagtctcggcatcgatgaccaccatccgatccaggtccacgttttcgattcgatcaaagttttgctgtttccggaacgagtccacgagtcgagcccgccacaggtgcatccaaaacactcgacaatagactggattgcgcagtacgaaacagggacgctgatcgatcaactcttcggtccacgcattgtcgggcaattgtagtttttgtaaatctttaaaatccaagtaaatcatgtcgatcactgtcagagtgcctatcgggcattgtgcaaatgtgcacgtggtctagtgcagagtttatgcaatgttttattaaatgcgcacaagtgtgtataaattggccaacaccatttgtcaccggtacagtctttattgtgttctcaaagtagacggttctctctgactatacctatcctgcatttaaaatcatctttctaaaatggagattgtatccaccaactctaagcccatctggagtactgcgcaaatctactctatagagcccgttgacgagtgcaatacgctgattgtagacgtcaaggatctgtatcgattgttcaagctgaagcgtaccgatcaaaagaaggtgcgaccagttggattgcaagactgtaaaatgtgcatcgaacacggagtgactctgaccaaggatgcactagactcgttgaccgaacctctggaggacgaggatccagacaaggcggacgccgagtgctgtgtggcatcgcacgagtacagcaatgcgtttggtgtacgagtactgggcaagtgcttcatctttcccctgcccaagatgtactcgatcaaaaactttagctttttccgatccatcatcgagttgagttttcaaatggagcacgcctacgagacggacactcccatgccggacaagatcaagctcgtcaagccgtccgaggagaatgagttttcgtgcgacgatgtcaagactttgattcacaagtacattgataggactctgaaaaagtttctgcaaaacgatttcaagtgcagcaactttagcattctacaatcgggcaaacggtcctatgtacgatcctacctgctgggccacagacacaacggagcccgtatgacgatggtggtggacaatgagctgggacccaattcaatttcgattccgcgagacatttacgacaacctggatctggccaccaatttggtgattatcaaccgtgacccgagcatcaacgatacgtgcatctatgtgtgtgaaatgtttcatcacgacaccgatccctgtattcacttgaatccgtttgtactggacggtctgcacgctgatcaggacggagacgacatctcaatcaattacctcaagtatgaaaactctatgaatcgcaacctaatgaagatggccatcaccgagatgcgcagcatgtcctggaactatggctaccggcacaatctgttttacaagccacgctatgcgctgggtcaacagtttaggcacttgctctacacgcacgacaagtggttcaaccagcactccaagttttaccgaatcctcaccaaggtgcaccgtggcaatctactggcaaagattgacactctgatgcacttgggctgtagcatcatgaggaatgaggtgcacgatttcatagaaatggtgttggcattcaactgtaagaatgtcgacaattgcctgaggggctcggactatctaaagtgtgacgatgagattctcgaagtggtgcactccaagtcaaagggcaccgcccggcacattgaactgtacaagtacaatctgacgaggacgtctgacgagcaggctctcaagtcggcctttgacgacaagattgattccagcaaagtgttggaacgcgagggtcagactcagttttcgctgttgcacgctctgtcgccggccacactgatgatgggcgatctctatatgggtgacaagattgcagtgaaaaactttaccgaaacctctctgatggacgtgtacaagtacaatccagattcggtgcgattcattctcagattgatactgatcaattcggaagagtttgtctccaagtggtgcaactatgatcggtcagagtatgactttacctttgacggtgacgatagcagtctgtttaccaagaagcgtcagatggccacctttagacgcaccctcaagtgcatcaatagcatgggcaagtctgaatcgacactggtgactgacattacgggaccaccgaatcgagtcgattccgaggctggagacaatctaaacattgcacgattcgtcaccgtgtggaagctgattacgcgcaaggtttgtattgagcgtgaagcgaaccgtttgcggctaaagagggccgccgagtacaacatcaaaaaggaggcggtcaaacgcaagctggacgatgagtttgccgcagacagtaccacttgcagtagcagtgtgcacagcagcctctacaagaagctagacccggtagagttggaaaaggaaatgatcaaggctgagattgcactctacgatcagttttacgaggactggatcaatctaaagaatttgaccaagaaccaattgtatctgttgtacacttcaaagaatcccatgatggagggtatcgacaagacacccattggcctacactatagcatcatgattcaatcgcaaaagattcaaactgcactgaacgtgaagcggctcaaggatgtcaaagagtcgcaaatgttcaacaagggcactatgaatccggttactccgtccatttgcatcaagtggctgtacgcaccaaagacgttcaactggtaccgagtgtcgttggacagtgtggccaatgtggatgcagtgttggccgcagtcaaggattgcgtaggctatgccattctgtacaagaatatcgtagagttttactttaaggtgggtggaccaaagattgtactatcgcagctggaacagttgaacggatgtcctcatgttacgcgcatagtgtttgtggccaactgtagagtcatgctggaactgtatcaaaagaagcaaatctcggcagtagagatgactgacaatctgaccaactttttgtattgctactataccaattcgctgtgcgtggatcacagtaaaccagagtacatactaatgtacaactttgtggccgtcatgtttctactgaatcgcaatctcaacaatcccaccaactctaccatcaagttgccgttgcacgctgtgagcggagagtttccacaacgagtgctggccaacatgatcaaacccaaacgtgcgataccacagcgcggctccataccggccagcaatagcaacatgggtggcaagagcagcactagcaacattttcccaatcaccaccaatcgtgaacggagaatgtttaaagagttgtgcgatgtgtttggcggcaccagtaccgagtttgtggtggacgtgtacaatgccaagtgtcccatgtccaatgacttttgccactatacagagaccaaagagtttatcggcagatgtagtggcccgcttacaaaactcaatatggacaatgaaaaggctatgaaagagttgatgaacaatctaatggatgagggtgaggtgtttgaagactttaagaatgccaaagtggaggccaacgattcggatgtgtccttttcggattgtaatgtaaagtcgatagatgaggatgaagatgttgagggtgtagaggtgaaggtaaattatgaggagtgtgttgaggttaaagttaaggatgaagttaaagaggaggttgagtatgatgttaaagaagagtgtaatgaggaggattgtaattttgtagagaatcaagaaaacccagatattgatgaaaatcaagagaatttagagaatccagatattgatgaaaatcaagagaatcctgaacctacagaaatggacgaggttgatgaaactgaggaagagggtatagaaaaggacttgtgtttggatgaaggtggtttggatgaaggtggtttggatgaagatgtcttggatgaagctatgcaacttgatgtagatgctacagaggacgatgaaggtagtgtagcaaagaggtctaggttggagtgagtcttggtgtattttgtctagtgtaacttgtaggttaattgtacctttgtaggatacttgcatctttgtaggctacttgtacctttgcagctctataataatacaactataatattaaatactaaatactaaataaaaatattgttaaataatatagaatactaaataaaactaatgtttaataatattgaatattaaataaaaataaatataaaaactaaacccactggtattcttattttttagagacccaatccggatcctttacttatcccccagtaccttgtcctaatacaaactaaagtacaacctataaagtacaaactataaagtacaaataaagtacaaactatcaactaatccaaactctacaacactctgccacaatgagttttacatccatctttagacgtgctctaaagccagtagacgagataccggccagtaccgtgagcacgctccgaaacgccaagaccggtatacgttcggttgacgatgtgtttggcacactcaactatagcctggtcgatcggcaactggccgtgaacggtgtaaagctacacactgtggaatcgctattgcgccgaggagagctggcgtccatgtttagcaagctgaacaaacccaccgccataacggtggccgatgagctaaagtttcgcaagctcatcgacaccccagacattagaatacgcaacatggaagagacggtaaagagtgctcgaatcatacatcccgacttggacattgtggtgactagcgcctcagacttggaacgattaccgaaagcctccaggaccaagctaaagggcatcgttgacaatctgtggagcacggtcaaagtgggtggtgtggcggtcggtatatttgcggccatatccatcggagtgccctactatgaaaagctggtagaggctacggttgcacgcaacggcttctacttggtggtgctcaagggaggcaagactacatcgttcaaggtgcccactagatcttgcctcagcacctccgtgacgggagtgaagcacatttccgcagtcaagtacgatcatttggacaatccagtcttgtacctattgcacaccatcaacgatcccagtgcagagatggaacggcagagtttgaccagtgtactgggcggtgtgacacccaccatggaaacgttcgagaccatcgtacagaacgacactctgtttgccaaagtgtcggaacactactaccattcgtcagagggtcatcctttgaagaatccctgcgatctggtgcagactgcggacaaggcaaaggtgccgtgcaccggcttcgatcccaatgccgatgagaaatcgtacgcctacgtcaatacgtatactctgcccgataatatgactttcaagtgtgtcaccaattctacactgctagagacgatcgttgatgcggcaggtgatgcggcccactacattctgggctctacgttcatgaccaaactgggctcgtacctgaaatacattctactggcagtggttgcggtggtgctagtcatcattggtcgattcgtgtacgtcaaattcaatctgggagatttgctcaaaggacggggacgaggacgaggaggtagtgctagtggtgttggaggtagtgctagtggtgttggtagtggtgatactcggcctttgttggaggatactgacagtgtggatgttgatgatgatgtagatgtagaatatgtagattaataaaaaaatacaacttgatacaattgtacaactttaattaattaattatttaataaaaaaatgtaatgtaacatactaatatatataaaatatactaatatatataaaatttaataaatgtattaagaaatgtaaacaatgcttttatttttacaataggtttgaattggtttacaaattggtttccaaattggctcacaacaaatctttaagcttcatcacacgatcccttccaaatccaaactagaaacatgtcagagatacctctagtctctatggtagcaatcttggttgctgttgctgttagtgttggtgttggtgttgcggctgttgctgttgtcgttgttttagaattgcagtaaccaatgccattattggatagcgacacttcaggtttaatgtcggcatggtaatctacaatgtgaactacaaagcgtggtatattttttagtaccacaaatataatgtattttagagcgtaaaattccaagtagacgtgctcgagtaccggataaaagatgggatcgtttgtatggattcgtctgttttgatagtctaccacaaaccatcctattgcattcaggtcagagtcgggaggcaatagtgcaggatctacgggatcgtttgttgtgcgttcattgaggaaatctatacagaaccattcgtcgtcacctctgtccgtttcgaatgcatcgatggtgctctcgacggaacactctgccgctatggcatcgcacacatcgtacacgtactgagcgctcggtttgaacgtgtagcattcgtgaaatttatgtgtagacaacacgaacggtggtgtgctggcatcacgttcaatgccttgatcaacgttattgttgtacgcttcattatcggactcttcattgttgctttcattaaacaccgtaccgttatcatttaggttgcacaatggtaaccagtaaccttcaaacattgtatgctagactttgtagtaagatcaagttgttggaaattgtgcattcactactactgctactagtgctaatactaaaaaataactactcgtacacgtgttgtttaaaatgttgcatttactcgatacaagaacagtattgtagtgtagttggaaaaatgtacactttttacattagtataaaacactttttacattagtataaaactaaactctattcttccagacattgctgcgtctgtagccactgccaaacggtatcaccggaggacgctcgatactcttcatgttgggcactgacgatgacttgtacattttcgatagtttgactcggaccaatttgtcgtgcatcgctagactcatgcattcttggcaaatctcaccgagttgcaccacgtgcagtgtgtcgtggataaacatgcgactttcaaaatcgacatgattacacttgccgccgtcttgacgtgcaatcaacaacaggtagcccaattgtgccagcttgaatcggtccactagtccatagtcggaatcttccactttggtgatgcagttgagtttggtcaatagatattcgaggtccatgtttgctcagacagttgctatttatccttagcagttactatctatgtttactatttattcaaaaaactagattaacaagtacaagtatatagacatttaaatacaaggaaatgattagttaatgaccgtgtggcaaacaatgaataggtttacactctcactttacatacccatctacctatagatttattaatacaagtatacgcttacaaccatattcttataaccatattcttacaaccatattcttataaccatattcttacaaccatattcttacaacaagatgcactttaggaaaaagttggtcttcaagcctggcttttcgatgctcttgaacagtaccaatagtacagtgtttacaatgctcctgtccatgctgtgtgacaatctaaccatttcacgcacatgtgtcggtttgcgtttggctttggtgagcttcaaaaaggccaccaacgagtccttgtaggcacgcacctcgttcaggttcacgtaatagttgcagtcttcgtcgcccatcaagtgagcaatcacctgatcgatgtattgcatgtcaaagatttgcagtagcttactattgatcgtggtcaatcggcaagagtccacttcgtgcataaattctaaaaactctttaaggctcgtatacgatgccaggtcgctgagcatgtgcggtatgttgtagtccatcgagtacttgggaaacagtttaaacagcacggccagttcaaacgctttacgattcgttatactgccactgattctctgaaccgtatcgaaccaccgtttcaggtcgtctgtgattagaccacgtctaacgtttacgcactgtttgcgcctgaggtaggctctcacctcgaacggtgtcacttcgtgatgtatgaaatcgtgcgtagacggtcccgcttcgttggcctcaaagacactaatcagccgatccagggtaaagtctttgttggtcatcaacaagacgaccgtatccagcgatatgtaatcgcatgtttcaatataagagtccagggtgctctttatgatcggatccatgttgcacaaatactataaaacacgtaaattgtacaagtctaatacgatatttcatttatcaggcaactgaatattgttgaacaaacgcgtgttacattcgcatttatacaaactcgactgagacgacttttgcagtttactactgtccttgctgctgctataacatgatacagatggcttttatagtatacgagtgccattattttgcattattgaaattctgggatgggtgataaaagaaacgacaaaactcctacttgctaatttatttgctaagttatgggctacttacatggtacttgagctaccttacacgctatttacatgctgttttatctacctattttacttgctagtttatgatgcattacatcaatttattgtgttgttgtattaccgcctttacattttacaacaaaagtgtgtgccactacatgctatgcttaaattaaaacaaaacgatgcgcttaactctacatgtgcaattgacctctcatttgaatgtttttgtgttttatgcttttacaatttttatgtgcattttcaaggattttgtattgtttttggggtttcttacattttatgctttttattggattttgtattttttagcaactatactatgtgtaaatcaaactatactatgtgcaaatctataaagtgtaaattttaacctaacccaaacttaaactaaacacccgtctctctacctactacctacctacttacctccctacctctaagcctccttaaacctaaacactaactttagaatgcttataccaacatttattatcacagtcaagtgtttactgcttagctacactttttacaaggcttaaactagtacttgttatgcttgattattatttctgatggttcagattattggtgcatctgattgttgcaatttattctcttattgctgataagtatagatgtattctgggctctcaatactcggatgcgtgggaattacctactactaatactactattagtacaattaataccaatgaaactactactagtacaactaatgccaatgcaactactgccgaataaataccgttgggatagattggggaactacttaccaatactactaatgatactaatgctactaatactaccaatactactactatgctaaatacacaattctatacaattaactaatactccttacaatataaataaatagcaatccaaggttgacctaatacgcagattcaaaaactatgctacattttacaaattgtacaaagctacaaattacaagttgcatactaaatggaagcactatataaatcgacactacttcttatgctggtgcttacactattccacttgttttacctgtaaaacttacacacgctaaatcttaaactaaaccttaaaatgaacgaaaccttaaacaaactaaacatttaataaacacactataccttaaaataaacacgctgtaccttaaagtgaaccaaaactaaacctttaaacttatataaacttgtataaacatagataaccctcgacccatacgacaaagacaccccacccgttaaacctacccactgccaatactattgaaaaaatcaacattaacctaccgtgttgttgctctactttacaaattacttaattggaacttactaaattggaaattacttaatttaaacttacttaattggaacttactaaattggaaatctatgtcaacattaaaaactaagaggaaatacaattcggaaactaaaactatccatgctaatatactctaacatacaactatgtagtatactatccatatctatacatgtagtaattctaaatcacactcttacaacactatagggggattgtcaagacgaaaaaactactgccaaatacatgtactaggatcaacgattccaacacactccatggtaaatgtccacatgtacacactcgcactgaaaccacttgcttttaaaaaagtctataggtataccagtgttcctgttggtatatgaagtgcaccttcttttgctttatacacttgaacctttgcacttgaacttgtattaatcaacactttacaatacacaattacatactaaattgaacattaattaaattgcaaattgaagagaatattaaaccaaatgtatgcatcaaagtggtaaagtgtacaattaaaaagccaatctagacagcaatctggaatgctttttattgtacaattttacgagaaatctaccagttattgctaagcactacaaaataatacacattaaaggatgcgtgcagtctacagataatcacagctcgtaatgtatgccaaaatagttatagtactaaataaattgtatgtaaatgtaaatttcaactaaataaattgttaaatgtaaattttatatggcttgtaaggtttgcatttattacggttcaagcttacaggtcttggtgaaaactaattaactttagcccattatgatacaacataaataatcatcttataaccatcaataagtaaactaccagtactgctacttgtatcacattacaacttgtggcatattactggcatattacattaaagtgttgttactttaaactcttacgatgtcgtaaaattcaacattagcacaccctcggtgggatataaaactgccatctttcatggaggaattttgatttgatgcctggtgactttgatgggtctgatgattttgatgggttttgaggtttactgttaaaaatgactattggcgtgaatgatgcgttgaatgttgattgaaagcaagttgattgaaagcaagttgaacattgatttgaatatataaaatctaaatctatgcgaccaaatatactctaccgatatacatgcacacaccttacatctaaaccttgcatctaaaccttacaactaaaccttacatctaaaccttacaactaaaccttacaattaaaccttataatatatcctacaaccaactacacattacactcgctatagttgcagcagcagcaatattagtttccatgaccgtgctagtgtatcctggttcaattcaagctcaagttcctaaacactaaactaaccctacctattcctactacgtatttcatcctattgtacactcaattctaactatactagtctaaactctaccatcttctccacttgaatcaattgcgttgtcccgtgtacctgtacgataatgtgcaaaatagagtgtctgatgttggacagaggagatgcaagatggcgagagtttgcaggttggaaattgaaatgtagattcttacactaccactaattgtaaattacgctaggattattatattctcaactattcttatagtctcaactattcttataaaaaacatgtaatggtatttcttatacacctactgtatcccatcatcacctatcaaaaaagaaacacattctggggctcaaaaattacatcatttaaatactgatatgtatatataaaaatattgtacaaattatatataaaaatattgtacaaattatatataaaaatattgtacaaattacaaattataaattataaatattgataccactatgctgaataaaaaacattacacagagagagctgttgctgttgatgccgtttaaacctaaaatcgacgttagagctttaatgtgcaattaaacctgaacacacaattaaaacttaacgttcaattaaaacttgaatgtttaaataactctaaatgtttgaataaaactaaatgtgtaaataaaccggcaattaaacctaaattgagaaacacaagccaagagtctaataaagatgctaaaggtgccaaagagtttaaaactgccaaagattctattttgtagactacaatttagagatagtagtagtagctaaactgtacttgagaaaacctctttgctctagtatttatattaaaaaacaatcgtcttgtgtgtgtacaattgttcgtgtcaagttttacttcttacgatgattctacagcctaaattatcattaaatagaaaaaatcacatacttgtacaaatgtgtatgattattgtgtatgcatgttggataaacggtctcgtgtaaaaaaaccatctacaaatccaagcaagacacatctgtatgaatgtttcatattacaatcttacaccctatggttcaattaaatctgtattgcttttaaatattatgtaaaacacacatgcatgttcaattattactattggaaaagtaccaaatccctataccaagatttttcaattttatatataaccttacacctctaacctatatgatttcaactgtattataaaataatattgcaaatgttataaaataatattgcaaatgtttaaaccagaataactaaaaaataaatgtaataataatgttgtaatccagtaccaccacgccactgattatgcatttattcctaggccaccaccaccacaatgattaaatgtttaaaaaaactctagagaccgagtcctagaccgagtcctagagcaactaaatctaagaaaaatctataaaaatccctgatgaataaacaatcaaaatccaccaccaaaacctaagctaccgatcccaccaccatgttataaaatgtgtaaaaaatgtaaaatatcaagtttataaaatgttaaaaaaaatgtatgcatctgcatgcatctacatacatacatacattctaaaaacatgaaatctaaatctattcttggtccaaaattcatagccatgtctgcataaaaggaggagaagaagatgttgccagtgttgttgttaatgttagccttcgcgaggaccatatttcatatttatgacatcctttacgagttgcatacagggaatcttgtttacgacactcctgcgtggagtcggtgaaagaaacggatccattataaagctaacgatcgaatcgatgcggctactccttggctggtccgtgtagccgttcataaacatgtctatggccagtttacgagtcaaccaagggaaatctctgatatcacaagatacaatcaccacggtagcagtggcctcggtattataactgggtgtagttgtagtatggtgaggcaacacaatgatgaatgttgtcatttgagattccgtgctagtcggcatcggggacatggtgattggatttggaatggccgatgcagttatggggttagcggatgtagtcgctgggtttgttgtgcctcttgaagttgtaacagttgtgcctcttggtgttgtagttgttgttccagtactagtgttgggattggtactggtactggtactggcactggtgcttgcaccggtggttactgtagacgtttctgatgccggagatgccggtgtaggttcagaagaggccggtgtagccgcagaggaggcttgtgtagcttcagatggcggtgtctcggacgatgccggtgtagcttcagacgacggtgaagtcgatgtaggctgagtagccggtgtagcttcagaggccggtgtagcttcagattgaggcgtagcttcagaggaggccggagtggcttcggatgcaggcaacacctcttggcccattgccacggaaaacaaacgagacgtaatgtacagcgtggtcagcatgattagattgaattgacgcttcttaccggatccggtggtggtggtgcgtttacccttgtgcactctcttgggtttgagcgcagtcacagtcacactattggccggattgacatgaatcggaatgtagacttggttggtggtgtcgtccaactctaccggatcaatctcttcgtcttcaataaacttttcattgcacagtagattggtggtagaagaaaaagagtaagggttgttggttgtagtaggattagtgttgatattggtgctgctattggtgttgatgtttgtattgttgatatttgcattggcattgatattaccaccactggtagccgttgcagttgttgtcgaatttttaaaattgacatcatctccacagaatggtagggagccattattgtagtgctggttcagatagtagtagtaataatagtaatagtagtagctggccgaagacggtagaggcggctcagtcgggttcttgatggattgctgttgttgttgttgctccatcagagtcggttgatcacttggacccttttgctgccccatcaacgcatgttgaccaatccaagcgttttgatccatcgtacagggacagaccactccggtaccgtcaagtttggtgcctgcgtgagagagagaattcaattgttagtattttgtacaagcttgcactttacttgataaaaactttacttgataaaaacacacaatacctttggataaaaggatgaaaatataaaaggtcttagagagatgtataaactctttacattaataaaaacacaattgtacaaatccaaaattatacatttaatcctacatacaagcctatacccacaatcctacacctacaatcctacacacaaccttacacgcaaattcctacattcaatcctacatgtaatcctacacattccatcctttgccatcctccgttaccagtctttacccctataaaaccatttgaaattgccaataaatcccaatctatacaagtgcataaaattgaatgccatgtctaaataaaactaaaaaaaccctacattccatacgtgtacacttgctaaatgtactatacagttcactgacccaatttcttgaccttgacctacttttgagccatgactgacattcggaaaaacatcattaaaacactaaccgtttacgataaactccactccttgagcagctccatctcgtcccttggcgtcggcggcggcgtcggtggggtagcggcgacatttgcaccagtaacagttgcagtctggtactcgagatagctctcgttcgagctcatcaggatcaaaatgtgcaatcgaaccattaggttgacgcatcttataaatgtcaccgtcaacaagagcagtaccacgaccgccaatatcatcaaaaaatctaagaccatccttcctcttggacttgatcggcgtgtaacccattataatacctcgcacatataacgtattgtagttttcagatgcaacgagcttacactataaagactatcgcgaccgcactctttcaatagagaacttgaacaagactggctgattagctgcacttgctcggtaatttatttgacggacgctcacagagatccaacctatacgtacgctaaacttacactcactagtatgcgcacacatcagtcggtgcagtgtgtgtagtgtaaacattaataaaaacctacaaactatgagttttatcaatcaaaacactggtgaactggttccgcattcggaactgaaacgatacgatgaggtggcattgatagaagcctacccagactttattgccatacgcatctattccaagacaaagggcccgaatcaacggacggtactcagcacaaagcccagtggaggtagaaaaatcaacgcaatccgactggagggtaaactctacagatatcgacacgtttccaaccagtggttgacgacttttttgaatacaaacaagaagaatattgcatttgtagtacaagacaccaccactttgggtgttcttagtcgccaagaaattttggcgcacatgaatttcatggcatttttgaaaatctttgaaaagtgcaaaaattcatttgaatttaagacaaagacgatcgaagacgtgctatttaacgatgtttgggtcaaatgactcaaagactgtgactaatggtcatctattgttgaccaagatcgttaaatcttggaaatgattagtgtgtgtgctttgtaataatgtaatgatttacaagtatttgtgtgtttgtttgatttttttaatcaagaagtaggatttcaagtaaattcaataaactaaactgacattttcgtgttttttaatcaaaaaaaactaaaaactgcacaaagtggttaatttcaatgttttattcaaccggtttctatgaattaaccgcaatttaatagcctagagaaattaaaaaataagcctagagggtcccttcattttttacaaagttgaaaaaataaccatcgctaaccaacattacaggaagttgtgcacctataatcatacaaagtctaaaatttagattggatttctagcatggcaattaaattgtaaatttacacatttatgcaaatttctaaactatgtgggacttttacgtatccgtcaagtatttatgcaaacggtaatgtctccatttatgccaatccttgttcctcgtacagtttggtttcgtgctccaccatgcgataaaagggattgttgcactctttatgtctgcgcttgttgtacgttgccggtatgactatcggttgcttgcagtcggtacagtcgtccatgatgggatacgcagagtggtagttgatgacggcactgggatcgcccttgcacatcaagttttccgtgtttgaaattgcaatacccaaatcgacggatttacacgatctcatgtacgaacccattgctggatcgcccattataaaggtgaacatgcccttttcagtgttgcacggctcaccctgaactatggcagtctccttgagtctattgatggatatttcacagatgccgtttatacaatcgtacaagtgattcatcttttccatgcacgagttgaggcattgtgcatcggtgaaacaatacaccttgtccactgaacagttgctcttgcgcttgccatattctagtcccgtcttgagagttgctctattcttagtggtgttggtgttgtctttgttgttgtttttggtagtgttactatgacagccaactgtgccaagttgaaagtaaaacacaagacacattacgagtgccaagagtgcaggcagtagatattgcatcttttctcatccatctatgtatcaagattaaaaaaattaaactcggttaagctataaagtttttcaatcagtacacttcctgtgctacatacagcaatcaagtttacattcctacatgcggcaattattttttattctacaattacatttagtttgaatgtggaatgagaggggtttgattgaatgtggaatgagagggtttgattgaatgtgagggtttgattgaatgtgagggtttgattgaatgtggaatgagagggttttggatgttggctaagagttttgattgaaggagggttttggatgttgactaagagttttgattgaagaagagttttgaatattgactacgagttttgattgaccaagagtttgaattggttaaaaaatgtacacttgacagttgcttaaacttttacttggatattctacactattggatactctatactattacatttctatactattgaaaatgccatctattctataatatttgatagtctacactattgaataaagctacaccatctacattactatcctaagacgaacacaatgcgattccaacctcggacactctaaagttgaccaggttgcgtgaaaagagcacattgacgtcgtcgcgagcatcaccggcaaacactagcggagacgctacatcagtgtctcggttcacgtcatagtaggcaatcggattggccacgatatcgtgattgatcaacttgaaggctctcgcatccaaatccaggtacagattgggtggaaacgatgtagcctccggaatgtagttggtcgacgcttcacagttgaagagcaaaatctttataatctgaggcatcagcgtcatgctcatctctatggatccgtttcggctgtaggcaaagatgcgagtgttggcaaatctagaattgagtgatttgtcatacttgtgaatgtactgcatgtagtcgcggtactggttcaggtacatgttgtccgagttgcgactcatgtcttgagatgcaatcagattctcggtaaacattaccgtcagaatctgagtcagatgacaagcagaagcctgatccacatcgagccggctcacccatgcctgcatctctgagattatattttcgatggatggcgatcggcacactctaccctccgacaccgagtacgggaacggaatcagtttgttgtcacccctcagattgggagtcggagccatgtacactttggtcttggccacattgttgatgacgacccgattcttgaccagactcatcgaaaacaacagattcagatgggggttgcaaatgattcccgccaccggtagagtgcatctgacgtatacattttgaaaaatgcaccgctgagcgcccgactgcgagctagttgaacagaacatgatttccgctaaatctataaacaatgacaacgcccatagtctcaatagtataaatagcgtaatatcaacagtcggttattagtaagcggttgaacatttgaagcggtaacacgctttttagcgttcagcagcaaacatggatttttacgcaaaaaccattgtcgacgagtacaacctaaaaatggacaaattgataatctacaattgtccttgctacaacgagtacgtctacgaagagtctaagcgcgtagacggcgaagatgtgattcggctcttgttaaagtacaacaaatcttatgctgcatgcatccaattgcactgtagcaacaatcaagtgatcgtcaagcacaaggtcttgccgataatgattggctccaagattgacatgatgattagacccaatgtggactttaagcatcagctgggagcctttgttttgaacggaggcatcaagattttaccggccttcatcaccaacaatctgcgatgcggccacgtgtaccgaccgagcaacgagtacaagtggtatctcaacgaggacgtgcccgacgatgccaacagtaccattgtgcacatgattcagtatccgcccaatgtggccgaatcacccgtcgtggaatcgggcagtaggcgcagacgcaagggcaactctacgattgcggcggtcaacactcgagtcaagctggtgagcacgaaacgaatgacggaaaagcgcgtaggagtccgaggctatgccatcaaggacgattgcatagtggccgacaataccgatgaggaaatctttgcactcataaatcggctaagcccggtgaacgcaatcactgacaatgcgcacactgtgactccagaggattatattgatttttttgagtgcagcatcaacaactatccagagctggacgatttgtgcaacaagactataatcacaccgacctccatctttgagacggccatcaagaaatggagcactctaccgcaaaactcttccaagctgggcactctggtgtcgggtaatctgttttacacgctatcctcaaagacggtgagctacatcaagaatgacgagttcaagactgcctacctgtcggtggagggccaccgagtgtcgatgatcgataagctcatcagtacggtaaagcgacacattaatcacggtgtgaaaaactcgaatgcactcaaactgccacgggactcgtccaactttatatgtccgctcaacgtcaaggagatgaagaatgccggcgagacgatggctctagcgcagtttgtaatgattgcaccggccgtttcactggagcggatcgtagactttttgaacgaccaccacagtccagaggcagagttgcgcgtagtgatcgagggctggctcaccaactatcgcattcggccgtgcgatgtcatcgaaatgaagcgagccatgatcgtggtgaccatggtgtacgaggatcgctatctggtcgtgtaccatgtaggtcacttgccggtaaagtattcgcccaagtatcgcatgtttgtgggcgtacacgaggccatgaacacttaccgagacgcctttgagggctacacatcgtttgcggcctacactacgtttgcgatgaactttcatcgagccctgttgcacatgccaccggcaaaggccaccgtctccatcaacaacatcaagggttcgtgctctacgctgacgagtcgatccgatctgcacgcattcatccactcgatcggattcaccaactctgccgtgatgaccaccaatattggcatgctgaccgattgcgacgacgaccgagaaaacgaacgtcaattgggcgaagagtttgagtgcgtcagctttaacgattcctccaagtttatgctggccatcaaggcggcggccacaaagtttacccatttggccgagattcagcccgagtgcaaagagtactatatggaggctcccgagacggtgcacgagtttttcaaagactacaatcgactgaagcgtgaaaacttggccataaccgatggcagggccgatttattggatccttgcatggtgggtgccaagacctttgaggaggagggccagtgctaccgagacttgtttgtgcacgatgccgatgaacactttgagtgcattcagcgtcagttgagcacaatcaagatgcaagactacaatgtgctacccgtaccgccggggagcaccagtaaacgagacgagtctcggtacgaagagtgcatgcaaatgaacctggacacgtactcgaacacgaaccgtatgctcttgtacacggccctgtgcaatctcaactgtgacagtgtagaggatggcatcattatagatgaaaactttcatcgcaactcgccactcaaactgttttcggtgactctactgctgagggtgtacgctcacactgacgacaagtccaccttttcgcacaaggccatgtctctgaagcccaacggcacctacaagtatataccgatcaataaaaagtttgacggagtcattgtgtttggagtgctcatcacagaccaccaggtacggatacagcgacgcagatcagtctatatacacaagtcttttataaagaacacttttagatatctaattacaatgagtgatccactgcgcaaatccaagactatagactctttctttcaaatcaacaataccaatcaaaagtcgatgatatccatccactaccactatacggaacgtttgggcgttggcaccaagttggccaatttgcacggacaaaagggtatcgtgtcttcggtgaaggatctgtcgcagtatcagttttggaccgcgtccggaaagatggtgcatccgcagatattgtttagcaaacaatctctggtgggacgtaccacgtcgtcgcagacgctgagcatgctcaacagtccagacttggcggtgaacggtgacggtgagatttgtgcaccgttggcctttttcgtgcaccagatcgaggccaatgccaagtgcaagcaaatgtttcccaagaacgatctgatgacggccgagaatggtttcgtggccaatggcctgattgccacgatgaatctcatgtccaagcagtatccgctcaacgagagcatcaacgagaacgcctttgtactggatctaatcaaactgggccatgtgcacttgaatctgagcccagacttgaaggcagtacagggaggcggtggtggtgatgggagtagtgttagtgtggatagtagtagtagcagtggtagcagtagcaatagtggtagtaatgtcgatggcagtggtgttaccaaaggtgaagttaaaggccgagacgaggagggagcctttgcattgattgaaaagtgcaaaaagaccaagagcaagggtgctgcattgtttggtaaggataaatgcaagaaattgaaggatggccacaaagagtgtaaaacaacaaaggatgctaaaaaggatgtggtccggagcaacagtaccggtagcattaaacgcaaactggaagatgaccaccaacacaagcctaaacgatccaagagcaacgaggcaccggtggatctagactcggattccgagtacgagtccatattgagatttaccgacgacgatgacaacagtagtgatttggactcggagttggacagaggaggttcaggctctgagattgacgagtcggatgtgacaaagtgtgagcccaagtctgagattaaaactgaaaaggacatcaagtctgaggttgaagatgccgactacaatgaacagcagcattattcggatgacaatgcaagtgtcaaatctgaagagtgcgacagtgatgttgatggtaatttggaaaagctagaagccgaatcggaggcctctgatttggaggacgacatggacggagacggggacggagacttggacggtgacggagaggacgagtacgatgatgatgtcaatgttgggatggatgattgagggggaggaggaggagaatggttgtttagtgttatggtagctatagttttgtattctgtaattttatttatattctatagttttatattctgtagttttatattctttagttttatattcttgtaatattcattcttatttttttaatatccaaatgttgtttaataaaatataatcaaatgtagtgtttaaaaaactaaaactaggatttgtacaattacattattacttgttagattataacaaccaattgtattaaactacactattacattaaaatctacttgactctatattacaatcttttatttaaaactcctttatttacatgcaaaaatacatatacacataaatccatacatccatacaggcacccatacagacacccatacatacagcaagttgaggttctcgacattagattcttgacattaatccacctttagtatcagatgctatacagagagagatacctctatctgctacataaaacctcctgttacattaacctcttacacaaaacctcttacacaaaacctgcattaaacggtactcgctttctctcaatccaatacatgcaacacatttcgcacctcttcaaataccgtccgggtttcattcaacagaattagatattccaaattggaaaatttaccaactagtgtggcgtcggctgtacatagtgcagcatgtacactggtgtgatcgtacgattcaaacttggtacgcatctgtttaaacttgcacgaattggtaacatggcacggatacactgccgactttatgactgcactattgttggcatttttagcattggcactactactgctactactactgcctgtactctttttcacaaacaaaaactgtttaatcaaattgttgatattcttgatgaacgccttgagtgcgaccgtaaagtttttctccaccttgatcatgttgttgaagagaaacagtgcactcgtaccgtttacgtgcaccgcattctccaagtagagtttgggactcttgttgagcagtgcgtgtgtacaattggaaaagagcaactttaggttttgcatcagcatactgtccagcagcactcccacaacggtagacgaggccggctgcagttgagctgcactacacagcaccggacacgatagactctcgtagatgcgttccacttcacccttcatgttcagacggtactgtactcgattcgaattggtgcagtctttgagcaactgcctagagcacccgtacttgaagtagattacgtgaaacagcatcaactgattgcccagaacaatgtactgatagttgcaagttatgctctggttgaacatcgagtctatggtgtggttgcacgacactgcagcgtaaatgtgcacctgtggcagatcgtgagttggctgctcagtgtcgtactcttgtaggcttagctgctttttctccatcgcatcagacctattgtaaactctagatcgtacaaagtgggcgttattgacgcgtttagatactctaaagattcgttcaagttgccctttattctaattagattgtatacccgcaatatctcattggtgatttgaaccattctaactattgggtaattcattgctatgatggcgtcgtcgtcctcgtcgaataggacgcttcttacaaacttgcaaaaactcaaaatgttgacactctccggcaacgaatgaacgatttttacgattggtgcacaatcggaaatccaagtgggctccgacgactgaggcagcgacattagcggatcgtaaactgtttcatagccggaatacatgaatccctgataccagacgtgaccgcaatcgtcttgctcccccaggtccacggtcgtagactgtatgcgtttacgattgattgaaactatgctgcctacgtttacaatgtatctacctagaaactcaaacatggcaatcttgaatagggacattaagttggattgactaatgtactcgttgctgaagcctcggctctgtttggtgaaccttatgtaatgcttttgacgaatcttgtgatatttgtagtttaaccttaacctaaagagaccgcgttcatcgctgcgctcaaacagatagtagtacggtctgagactgttgccttcgttgttgtacagatgactcctggcatttacgacatctttacaattgtccattgtttttgtaaaatactataccttgcaattttccaattatatactgaatacggctcaagtcgtttcatggcaccaaacgtttccgttagcacgatagtgacaatgtgttattacaatagtccaaggttgccattatgaaatgtgccattaatcatcatgcctatggacctagagtttgtcaagccggacaacgtgaagagcatcgctactattgcgctaaggcatgcacgcaagtgcaccgacaccatactcttgcacgtttccaatgtgcccgaacgtaccaaactgtgtccgtcgtccatgtacattagaatgtatccatccaacaatggctaccgtactctgggcacgaccatcaagaaactaatcaaaaccactcagcaacaacaacactataatgttataattctagacaccaacaagagtcaagtgttgggatccaagattgaaaagtttcacgatgcttgtgctctatcgaacgtggtcagcaagattacctatattgtgactggattttgatgggggaggtgtgtgtattgtattgttttgaattggattggattgaattggattgtattgaattgaattaaatcagagtctaaaaaacaaaaagtattttagtttttattaaacaagtttattaaacaagtttattaaacaatttattacaagcatagattgtttaaatgtctacatccttatagaatgccttataaaataccttacaagtactacatgtacacaaaccacttgtacaatcatctaccttataattaaccctgtatgtatatccatcaactaaacaattcatgtacattttttaaacataacaatttttaactggttttaaatgttttttaaactactaaactctacaaccatataaaccaactctacaaattacaaaacctttctaacaagaacacgacgtacacacatcatcaaaacaaaccatttgattgcgtccagtcaactctattgattcctttggctctattgattcgtttacctctgttggctttggctctagttgacacatttgagaattgttttcatcatcctttgatttatcatcaatatccatgcaaatctttttagcatcactatcgaccaactcaaaggaaggctctttgcgtttacttaaattctcaacagaatttgctgcatcaagtttagcctttagtggcgccttggttggattctctgcaatctgttgcataaacgtaatgtgatgcagtgaacgtttagagcgcatggtacgactgaggttgcgctttgttccagtgctgctaggattgctactaggattactactactagtactgttactagtagtactactactagcactactaccagtagtagtagtactctcaacaccaccactactaccctcaaccaccaacaaagacttggtaaacggtgaagccataaccctgccagccttcatttgactcatcaacaaggcacaacgattcacgtccaccgtaaatggtatggcattggtggccgactttgttctcagatagtacatgcccgtcttgagacccttgttccatgcgtaaaagtgtatcgaagtcatacgactgtaggtgggctcggcaacgtacagattgaacgattgactctggtcaatgtaggcacctctatcggcagccatatcgatcagcgtcttggttggaatctcccagacagtcttgtagattctgcgcaactcttccgggatgatggtaatgttttgaatggacccattgttgtacatgatcaactgggccatgtcatcgttccacagattgagccgttccaagtctcgaaccaagtgcacattggtcaattgaaactctccagactgggtgcgtctctggtacatgtttgacgtgaacggttcaaaagattcagcattgccaaacacttgggaagtggtagccgtgggcatcggtgccaccagcaaagagtttctcaaaccgtaccgagcaatgtctttgcgcaacgatgaccagtcacacttttggctgtgcaccgagtatcggtcgaagtgcaactctccacgactggtcgggctgccgtggtacgattcgtagactccgtgcactcgggccagttggcagctctccgtcagtgctgcatggtagatggtttcgaaaatgtcacgattcaattgcatcgagtcctcgtaggctatacccatcatggctagagcgtctgcgtagccttgcactcctataccgatgggtcggtgcttaaagtttgacttggccgccgagggaatgggatagagtgcattgtcgataatcttgtttagattcctagtcaccagacgtaccgtctttgccaataggttgagattaaacactttaccctctacaaacttgggcagattgaccgatgccagaacgcaaactgccgtctcgtccggagaggcgtactctacaatttccgtgcacagattggagcccttgatggtgcccaagtggcgttggttgctgttgcgattcacggtatccttgtagagaatgtacggagttccagtctctacctgagccgtcacgatggccttccacagttctcgtgcatcgactcgtctcacgtatcgaccctcttgctcgtaggccgtgtacttggcctcaaactcttcgccccagcaatcggacagaccgggtgacgagtcggggcacattagactccagtagccaccgtcgttgacgcgcttcatgaacaaatctggcacccagagtgcataaaacaagtccctggctcgtgcctcttcaaagccagagtttttgcgcatctcgataaagtcaaaaacgtccgcgtgccaaggttccaagtagacggctatagcgcctggccgtttattaccgccctgtgtaacgtatcgtgacattgcattgtacattctgagcattggcactaggccactggcgttgccgtttgttgaatgaatcgtagagtttttacagcgcagcttgtgcacatgcaaacctacaccgccacagtgttttgaaatggtggccgcgtcctttagcgtgtccataacgccaccgatgctgtcctctttgagttcgagcagatagcaagaggcatagttggaacgattcgttgccgcatgacacagagtaggcgtcgaatgtacatagtagcggttcgagagtagattgtacgtttcgattaccgattcaatatcccgaccgtgaataccgagcgcggtcctcatgtacatgtgctgtactcgttcgcaaatcttaccgtcggccagctttatcagataggtacgctctagcgtcttgtatgcaaaataggtcaaagattgaaaatcgcgatcgtctacaatggccgagtccaaggtgtctgcatgctcttgtaccaagtcaaaatagtactggggcacaatgttggcctcgtacaagtctcgaatcgtttcggaaaacttggaacgagtacgtttgtgtagcgcctgcatggctatgcgagcagcgagtatcgaatggtccggatgcgcggtggacatggaggcgcaagtttcggacaacagagtgtccagctccaatgtcgagactcgatcgtacaggcccttttcgacatcggccacgatgcctgcaatgttgataaaggcggtggttaatcggggctcggacatggtcatgcatctttctatcctagcgtacaatttagatggatcgaatcgttcaactgaaccgtttcttttgacaatcattctaggattccgactcattttcaagctaaactagctaaggctttaataattacccaaagacaaataccaataccgtattgtacctaacacatcatctgaaaaaagactaaacgcagtgtgttcaagtggatttatttaataaaacaacatcaggtttacatgaattaaattacaaaatatagagtaattttaattaaaatcttaacaatacaatacaatacaatacaatacatgcatacacaaacacattggcttacacctcactagcgggtacatagtaatctatcgtctttttgtaaaagttgccggtagtgttttgggcaaacagactcttgtaggagcgagccacgttgtacgatttcagtgctctagagcctcccgtcgtaatcaccggaccatacttgttcatcatgatgggtgtacgttccacgtgcactccctccaactcgtcaacgtccgtattgtagagatccctaaactctcgatagtaggatccgttcaccgagagcatgtgcacgccgcgtttgatgcaaatctttaccgaactatagccgcgattgtccaacatgagatcgtacacgaaaccgctcttggccggcaccatattcatatcggtcagagtttggtaaatgtttttgaccaacgatctgcgatgcatgtacgccttcatgtactctttaaaggtcttttcgttcttggtaatgtttagaccgttcatgaagctcgaccaaatttgcgtgtgcatgtacagagagttcatcggtttggtgtcgtgtagaaaatccaacaaacccttgacctcttcacgcttgcacgacaagagcaatcgatgcaggcaactcttgttgttcttctttgaatagtaaatcatgtgcttgtagctttgtctgatgcgatggtccatcttgttgggtttgttgcgcttggccttgtcagcatccgcctcctcaggctggggattgttgtagactcgtaaacgattcgcaccattgatgctgctcaaaaactggtacactctcatgatgtagtccaactcggctcgatagtggatcatcaaaaaactcctacactcgcgattgcacaggtactcgagcagagtgcgattcttaaagtgtctcatgtacgcacgaatgtcatccgtgtacttttgtgcaatcgattcgtcctcctgagagagtttaatctttttacaatcctcttgaatcctaatggcattgtgttccatttcggcttcgagtcgcttgtacgagtccagagtgcgtaaatccttggtaacgtacaggcactctttgagagacacaaacgatgcctcggcctcctcgggggtcatcttgcactgtgcgcaaacgccattgttgaatcggtggcagcatctcagattgcgcagagtggcatcgcgattcggtgcattgtcgattaccaccttttgtccacccttgagcttggccaacgtcgatgaatcgtccagagcccggctgagtgcatagtcggtgtactcttcaatgaccttgttgagaaagagttcctttttaaactcgttgattatgcagtgcacctgactcttgtactgtatatagtttcgatccaagtcattgcacgccaccgatttataggtcctaaatttgagcacacaccaatccgtctcaaagtcacccttgatcgtacgaggacgcttaaacatgccaaaattgacattttcaatggtgtgtactccactacgtttcatggttggtaaatgtaggtaccggtagtaaagagtaggtaaagagtaggcaaatagtaggcaaatgtagatggagtaggtatcgtgctaaagtataggtataacgctaccactagtgtgtttgcactacaaataacaatggcagactgtatcgacaccgtacgcgcaaagtgttttatataacattcaaacgtaaacatatcgataatacggtattgcccttaaaaggcggtgatattctatagattcgagcattgtaaagctttgctttaataactgagactactcaaacacttgtaacaaaaaatggcttcttgcactttcaagactttgttgaacgtagactcggagtgcagcattcagaaatgcaaagactactacaagaagctcctcaagggcatcaagaccaaaaagggtaaatccaaggtgtccgtgtttgtgaatcgtctagtggaccgtccctatgaggctctgctgacggtcaaggatagcgatactctgactttgcgagtgccttctgcgtttgtagactcgatgaaactctaccagtgcggagtcgtattgtccggtgtgttcatcacggtgccgagtacgtgcatcgtgatcacagaccaggcgaccgacgatgccccaatcatcgtgtctccgttcgcattggacactcacaatgccggcgagtttggtgttgtcatcgccaaactcagagacttgaacgatgccgagaaacaagactcgcacctcagcatcgatctcaagattaaactcataatggttgatcgtaccgcaatgagtacccacaccaagccggccgatgcacccaaggtggccaaagagttgcgtcccgtgcacatgggctgtcgtcgcgatctctccacctttgatcgtaacctgtggaagattagcaactgtaaaacactggacaagattcccagtggagtgttgccgttctctaggcaaagatccatcctgaacggtgatcaatttatcggaaacaactactatagaaagactccgtccgccaactcgctatcactcaacggattcatacccaaggtgattgttggcaactttgaactggtgcagcgtgactttaagggcatcggtgactttggtggaatcgatcgcggaaaccccaactatgacgagtacaagaagctgttgcgtactcaccctcgtcctcccatggacgacattcgcaaaaagatgatggaaacgagatgcttggaggaactcgagagcggaacttgtcaaaagcgcaaacttgacgtaaaggctgttctggcagaggacgatggactcgatggggaatctgctgcaaagagggtcaagattgaacaaagtgtggtttagatttagagtatagatttagagtttaatttagagtatagatttagagtcaacttttgtaacaatccttagactaaaaatgcaccattgcactctgtaacctttcaattctgtaatctattgaatcccaacaataaaggctatttttttagcaactcgttatgagttttgattgcactcgaccttgtcctccaattgtacaatacacttactcatagctaccagtcttatcttgaggatacaaaaccaaacacctactaaacaaatgtagtttacatgttttgaaattatcattgtacacatttattattgcattgtacgtgatactacacgcacgtattcagggtttagaaaaagtatttaattcagtaggtggtctagttattttttagtacacttccggcagcgatcatgaagaggtctgccaacttttcaatgtcatcgagttcggaggatgcgtacgcagatgcgcatcctgccgccaagagagtcaacaatttcaactcggtaggattcggcgatggcaacgggttcggtaaacgattcgatagcactcaatcgtccaccgatgaggactcggagattcccaagcctgtgcagccgagttcaaagagcaccaatagtagcactttaaagagtaccggttctgctctgaatcctccaagtcaaaagagtttactgaatccaaagagtatcgcgattcaaaagagtactttacaaaagagtggtatacacaagagtagtgtacacaagagtgttgcacaaaagagtgttgcacaaaagagtacatctcctcatcaaaagagtactacccaaaagagtacatcacctcatcaaaagagtcctctacctcaaaagagtacaaatcaaaagagtacaaatcaaaagaatgcactaatcaagagtgcgattgaatctagtgcaaagagtgccggtttaaagagtccactgaacacacaggatggcgtaaagagtccacaggatgggagcccggatagtgcaactagtacaagtgtaaagagtagtaatgaaaagagtgtaggcgccggtagcgctagtccaaagagtagcgttagcagtggtagtgtaaagagtgtaggtagtagtggtagtggtggtagtgcaaagagcaccaaaagtaacattagtgcaaagagtaccaagagtaacattagcgcaaagagtgctaccagcagtattggtagtaatggtagtggcaagagtacaccgagtgctaataatggacagagtggaaagaataccattagtggacagagtgtgcaaagtggaaagagcaccattagcacacagagtgccaacagtggaaagagttcaagtttaaattcaaacagtttaaattcaaacacaaagagttcaagctcgggcatcgagtccaataataatgccaagagtgcacactctgcgtcaaatgtaaagaacaagagtgcatccaataccgagatggttaaaaaggattgcaaagagcccaagcaaaagcagccacaacccaaggagtccaagccgagtctagctcaacaacctcaaactcaggagtccaaatcaactcggaagcaacatcaaaatcaacctcagaatcaaacgcaaaagcaacatcaaaatcaacctcagaatcaagcgcaaaagcaacatcaaaatcaaactcaaaagcaaaaccaaactcccaatcaaaagactctggcacacattgcatccatgaccgagaacaatcccaattgtgagatggagtacgaaacctactttgcactaccagtctccactcacattggcgagtgcatcaaaaagaacattgcacgcgtagacttgccacatcgtgaagtgtgggtcatgtactttaaggacaacactcgagtcaccggcaccacatctcagcgcaaacacgtaatctccaaatcccgacacttgtacctgagcggcacgatggccacaccgattgtgattcccatgtgtcgtaccgtatcgatagaggagaatgtaccctttacggcatccatgagcgatctctcgtcgatggtgcaaaggtttgtgctgtttcgcaacaacaatattcgcatcagtctagagtgcaggagcaacggatccggcaacgagtactacatatcgggcgaggtagagtacacgctagacgtgctcaatgattttcacggactgcgcatgcaagaagcggcactggtgtgcgaactcagagacacactgggtcagtactttgcctccaatgtggtgtcaaacataatgtgcgtactgcaccgattgcaaccggccacgcacgattccgtcttcaagatgccgtgtcgagtcttttccaagtttcacaaggtgcagatacgcgacagcaagagcttcatctacaagcacaagtatgatggcttcaagtgtaaactggtgtgcaccgagcccaacaaggtcctctaccaggatgacaacatcaagtttatacagtttaattcgtcaatcttcaacactgtacccaacctgtactttcaattggagaacatgtgcaccaacggcagaaaggaatcgcaatcctcgtccgagggcatacccacagtgataatcacagacgtgctgggagtgcgtctcggcggtcaactgttcatgcccgaacccgaagaggtgctcaagtttctgtccacgttcaatcgtcaacagcagtatgtaaactttggcgatggctgcaaacgcatcctggtgcaagagtccatagacgtgaacgcaaccaccaagtttaagcgagacggactcattgtcatttatcgcaacaaagagttcaagttcaagtttcccacctttgatgtgaagctcatgaacggcatggtgtacgtaaagaatagcaacaacatggacgattcgctgaatctgattcactatgacaatatgccggatggcatctatgaggtgtcgtttgacaacctgcaagccggcaccagcagcatgtgcaatcagttgacgtttctgcgcagacgcaccgatcggctgactccgtctactcgtgccgaagtggaggaggccatgcacgagttggatcttatgattggatgtgtgtttaaactcaagggatagatttagattttagggggagatcgtattgtatgttgatgtatgttgttgtatgttgatgcatgctgttgtatcttgttctatttgcgtatacttgtagtttaagaaatgtttgtagatgtagctgtaacacatacttgtaactgtaagccatactggtaactgtaagacatacttgtatccaccattattctaccaaataaatacatataaacatttacattttttagtattatttaaaattcagtaatcgagtttaaaaaaatataacaaaaacgagttgaaaaaaatagaactcggcgcccagtacctatatatataatatatattatagtatagtatccccccaaataatactatagtacgatacttttgttgcatcttgtacgacaaatggctgcaattactgctatagcaattgcacccaaagtcgtcaaaagtgcacaaaaccaccgtctacagtatcatcttcaaaagccctaaaaacgctgtttttgcatgcctgtgcgaaacaggacagcacgcaagtcaaaagtcgattttaccaccaaagtgcgcaaagtgctcaaaatgagccatctgcacactcggtgaaatttgatgatttctgaccaagttttaagccagcttatccaacgcctaacgtaatttacagagcaaacgcaccaaatgtacgtgaaattgcactgaaattgcgtgaaattgtacccaatttcgtgttaaaattacgagtttaaaaagtatgaactaaaacttgaaccgaaggggttcacaataggatgcattttacacattacggcatgtcacagagtgtagttttgcgcacatttcatgcacaccactacacctcaccgtaccgtgcaaaatgcacacccatcacggagacggtcaaatgagcccgtccgcataatacttgcaccacaatataaccccaataccgtattggctctatagtgcacaaactgtataaaaatgaaaatgcgcaaaacacacgcaaatgttgaaaattcacgcaacccgtactcttgctattggttgcacggtaggcgtttgagagactacctttgaggtcatactcgagggttgcgattgaatgttgatgaaaaaaatagaatcacaagcaatcgttacaaatacaaacaatcattacaaatctactacacataattttacaagactactagtacaaatataaactaatgatatctcctagtaaaaactaacactacaataatccacaacctaagcatcatactcgtcaattgcattatcaacctctacctgcatatcgtcaccgttcaacactcccccggtaccgtacatgttgagtctggccatcgcctctggatagttggcgtttagcactcgtatccattcgcgttcatttctcgccacactagactctctggcgaaccggtagagggtggccctcatgcgctcctcttcggcagccgtgtcgaccacgttgtccgtgtctcggatgagtgaattcaaacgttccagcgattgctttagttgcatatagtcggccatggacattgtgccgggatcgtctactcggaaatcgatcacatcgcgaaacaccaccaccggtgccttgcgtcccactatacgaatcgatcccatcgcattgtccgaagtgccgatgccgtcaaagagcgcctgagccggaccctgtccctgagtaggttgttgttgttggtggtggtgctgttgttgctgctgcggttgtagcactggaccgatttgagaactctttacgctgccgagtgcgtttgtagtctcgggtcgtcggtcggtaaaggtaaagtttaccggagtcgcatgcttattgatcatgtacggtgcgatccaaaaataagtagacttgaagaggtagttgtcggcgtctacactgacctgacccttggtgcgttcacggtacacgttgaacgagtaccgatcctgcagaggatcgtgctgcgcacccgtcctgtagccaaaagtgatgggattaagaaacatgatttggcaatgtgcatatcactaaactgaccagtatagataccgacaacaccgtgtacgagttatgcattcgaaaaacaatagattagcgtttgtcaaagggattgcgtatgacgagtctggagggtttgcgcacagccaccgcctttttgtagacgtcgcacaaccgtgcaccggtgcacactgcgactcgactgcccgcctcgtaaacccctagactcgtcgtccagatggccatcatgagcacatctccaatggacgagtgcatctttgtcagcagatagtagttttgccagtcgctctgaatcatcttgaacagagcactgttggtgtagctagagattttagcgtcacccttgcgattcttcatcatgaccaacgagtctgagaaggccatgtcgctccagtaggctcgatcgttgcgcctcaacaggtccaggatgattttgaaatcgtactggaacccgttgtgggcaatgtaaagtatgctcgaaccgaacctcgaatgcagctcgtcaaacacttgcaagtgcaaatctgtgcgtacactcttgacgcatcgagcatagatcgaatcggttcgtatgtcgagaccctcttcgagctgctcgtacacgcttcgaatgtgctcgtcggtgagttgtaccactgtcgagtccaccactagcacggtcagatcccgtataccgggcacggcttcgactccgcactcgagagcgtacatcttgccggtgggctcaatgtccaggtagcatcggtagcgatactgcatcggttggtagtgcgacagccatcgtttgtagtcgcactggttgtatttgcgatgaggcaactctttgtaggattccaccctacacttggcatcggagagaagcctaacgatgccactattcggagaatcccaattggtaaaattgccagtggagaatcgctttgatgctggtttaggggttttacgactagtgttggcggtggatggcattttacctggactgaatctataggctaatagtctcgctctctacgaaatggactcgtaccccagacacgcaatagctccatcaacgtttctaaacaatttcaatagcgtataccctattggcgtaaagctcaaatgtagcaagtagagaggctgaaaaaaaacaaccacccgtggccagataaaagctgaagcccttcaaagcacggtatcatttgcattttgcaagtgtacgagaacggttgtgtacttttagagcggaaatcaacatttgctgataagatgcaatctgaacaaaatcagcacaataatccgctcaatgtgtacgagctggaggatcattttagcatagattcaaacttgctcaatagcgagaccatcaatagttcactgtatcggttggcctctttggatgcctaccgaaagtacaagaccaattttaagattgtcaacattagactctctttgaatactagcaactctacagtgctgtactcgtttacgacatcggatcccagtgttgtagcgattcacgagtctctacaaaaggaacgcgaaaccaatgagattagcctgcccactgaacgattcaagactcgaatcgaaaaggagggctctcgtgtaaagtttgaaaagttgtgcatgacctatcgtgatccggacacgcagcgagtctactttaggactcacaccggcaaagtgtacgacaatcactatagcctgggttgttttctggaaaagaggcccgatgagattcccaccattgacattgattgcgatcacgtcttcaagactatagagcaacagaccaggtccggcgacgaagagattaccgtcagcaatatttgcatcaagtgcaatgcagacaagaagaatctacgatcgatgccaaagctggtgaagcgcgatcaattggaggtgctagccaagctgctcaatgttttgactgatcgtgagtttgactataaagagtcccagactgttactcatttgttttcgatggcatagggggggggtgtggaggatgaggatgtttagtgtgggtgtttaatattgttaaaataaatatcttgtttttaatcatcttttattttcactttaatattacaaaggaacattattacttaattacttaatattttaatatgcaaagaacacacagtaaaacgtggcgaggagagagaacattgacaatagacaacagagttaccatagttttaatacagaagaaatataaatgtaccacagatactaacaaatatcttgtgtttgtaaaataacctgtattatgaatctattgtgaatctcaaagtaagcttgtattatgaatctcttatgaatctcaaatcaaacctgtattatgaatctcaaagcaaacctgtattatgaatcttttatgaatctcaaagcaaacctgtattatgaatctcaaagcaaacctgtattatgaaaggatctcgatatacatgttctctactctgaaatagcaatactctgaaactctaattcaatactctgtaactatatactcttttaatctatataactcggcgtatgtactctttaatcttggaaacctctgtctatgtactcttttaatctcttaactatatctacatactctttaaatctctgaaactctgtatacatactctttgaatctctctaataaacgattatacaaactagactagttatttttttgggtactcttatttgggttttgattaaaaaaggtgaaatattataatggctattaaatttgttaatacaaagacatttcaaaaaacacaaaagttgtacataaagtggtacataaagtggtacacaaggcatgcaaaatggatacaaaactagaaattaaaggaattatataaattagaattagaattagaaactaaaacccaaaccactacaacccaagccactgcataaactaatacgttttgtaaaccaaagagtcaatctctggattcggtggtggcccaaacttgggcggtttagatggatcgtggctgcgatggtagtagcccgccagagccttgcccattgctctacactcggcatcgctcatgtcgtaggcatcttgcgctctgtgtgttggcattccattgtcctggtagtagtttagaatttgctgccaacgcttggccaatttgagactcactccgagcggtagttcaaagcccttgggtagctctacatgatcgaaattctcctcggcaaagtctcgaaactcgggcgctgcaacctctagcggcttgggtagtttggtcactttgcgacgtctgatgccggtgactggatcgattatgaacggcggtagaccatcaccatcaccatcattggattgtgcagacagatcgcgccttttgcgagagttggattttgattttatagcttcaaagtctgcatcgtcctcatcgagcagctcaaggaaatcggcagctccatcgtactctaccacacctccgggtggattgtatgtaggaacaaacggtggcgtagaaggtggcgtcggtatacgaggaggcggtggtgtagaaggtggtgtcggtgtacgaggaggcggtggcgtagaaggtggcgtcggtgtaggaggtggcgtcggtgtacgaggaggtggttgtgttggctgtagtgtggaatctccattagagtcgggctccttactcaaatcaatatacgttacttcaatgggtttcggtggtggcagtaggctatagtctagctttgtagtgtccacattctctggtgttggttgtgtaatttcaattaccttgattggatattcggtattggactcggaatcagatttatcatcaatattggaatcggtcgtgtctttggttttgttattggatttgtctttagattgatctttggatgtgtcagtggatttgttattggatttgcctttggattggtctttggatttgtcattagatttagtgtaattagtagtagagctagagtcaatattagatccagatgtattggaagcaggggtaatatcagttttagaaatagaggcaatgttagaactagatggataagaaatagaggcaacatcagtattcgaaatagtggaactcttagtattagtaacagagggaatctcaatattcgaaacagagtcaatattagcatcagaaggtataataatgcttgcaatcttggagttggaatcatcatctactttagattgctctttacctcctaaactaccttctaaactaccacctacactgcctcccaaactacctcctcctacgccaccaacactaccacccaaactacctcctcctacaccaccaacactgcctcctaagctaccaccaacactgtctcccaaaccacctctcgcatcgctaccgtcacgaatgactacactcttgatgccactatccgtaccgccgttctgtccacgcaacatgtttagaatgctgaatctagcatcgtcctcggcatccttgtccgagggtttagtcgctttggtgttgtccaccttttcgccctcctttacgtccaacactgcgtagccctgtgccagtaggtagttgcacgcatccaaaatggtgaacctcttctcgtccgattgcagagcgtccacgtcgaacgtaagcttgagcacattgtgggccgtattgcgatacagctcaatcagctgcatcttggtcaacgacaggcacacatacttgaacttgtcctggttcgagtgcagtttgacggcacgcgtggtggtcggcggacacttgtgctgcacatcggtcagggcgtacatctggccacctttggccacaattatccaattgaacggttgcaccagaattagacgatcgcagtagtcgtcggtggatttgtcgtaaatctcaaagaaggatgcgttaaactttgtagagtcggtggcctcatcggtgagtgagcccatagtcttgccgagatttgatgtttttaacaaactgaacgtatagactattgcaattatcgcaatacctaatactataaacacttggtacttgtcaaagtatttaccgatagtaccgatcattatgaaacgttttgccaacgatgaaaagtccaacgatgacaagggcaataacaacaacaagaggcccagattcaaaatgtactcttctcttgtctatgaacctacgcctacagtgattttacaagagtcccaaatagactacgatcacaactacaatagcgcatactgccaagatattgccagaaatcagacaaggttcctccagtgcaatcgggccgaggagactgactctttttcggttcgcctgtacgattgcctaaacggtgaggtggtccgagtgcgcaacgatgccctccggctggacacgttgcgtgactactttgaagagtctggccacactctggccataccaatgagccacaattatcagtttaagatttgcttcgatctagatttgaagccctcggacgatgacggtatcgaagagattcccattacccagctgacgatgatgtaccgagactttacacgagtcttggacgctagctttcccggactcggtatatgtgagcgtaacggcttcgtaatgaccagaaaccgaaacgttcacatttactacaatgtggatgtcagcatcatactctacgataccatgattgatgtgctaaactgtcaactgccaccaatgtacacggacgtgtacaagattgacaagattgacaaggtgccgttaccgtactcggcaaagagcgacggcaacgtttacacgatgcgcataccaccgggttgcagcgacaacgagcacttggccgcagctaaacccaaacccaagtctaaatctaaaagagctgctagtgatactgctactactactacctctactacttttactactaatattaaaaataatatgcaaaataataataatgataacaataatgctactgttattgatgttaatactactagtgctgctactgctgctactaccaacaatgttactaccaacaattctactaccactcttattgatgtaaatctcaatgttttaccaattgttcctaataatcctaatacttgtaaccattctacaaatacgcctactgtttgtacaaccgcaactaaccacaacgacaacactgttctaacaacaccggcaggcactttgaatgccaactctacatcaacctcttcttgcatgtacatttcctttggcaagagtgaatacttttacgactactcttggtatcagcaacgcaccacgatgggtgccaacagtcgaccgctgctcgagtacgaggccaaaccgatgaagattaccgtaacgctcaagtctatagacaagcacaattacgtgtacctggtgctgcccgatgtgggcaacaacaagattatccaagtccggcaacatcccaccttgttggacaccatttgtcggctaaagctggaatcgatcaagagcgtacagtccacgtaccagttgttggatttcgtggtgactatgcgcaacgagttgcgtctaaagaatagcgtaactctgctcgatacggacacggtggacgaacgcttcagaccgatacagcaatcgctggtctcgctcaatcgctacctggccgagagtttgtactttgcgcagtgtgatgatcccaatgcagagaacgtggcctacctaatcagtgctctgattgaaaacgaagagtactcggtgtacctgttgatcgtggccatcatgtactgttgcaacgacagcatgtcctccgaggacgacgagaccatcaagaatgatgtactcgactatttgagcacgttcctctcccgagacggtcacaccgagtctctgattgaaatcatcaagagcatgcgccgatacaagattatgaacgaactctccagatcgtttgcattgacctacaacgatctgctagactatataatcttggagatttccataaagcaaaagaacactatgcaagagtacgtatcggccgtgatgaaccatgtctttagtctgggcgccgtagagggtcccagtgtggaggcctttgaggtaatcataaagctaatttgttttcccataaagatggatttcggagaagactgctacatttacaattacaccaacaaggcctacgaacaagtgacccagctgaaacagtgcaatacggtgcgtctgattcagtcgttgctgggcatcggtgacaccatgtccaagggagaaaaggacattgcgtgcaccaccatcattgccaatctaaagaaccgacagatgcgcttcaacgagtacacctactttatcaacactagtcacggagtcttttacacaatcactggaacctatctacccaagactccgtttctctactttaacatggagaagcgcttctgtgcccacactctgagcggatccaaagatttaaacattatgaactttcaattgctaaagacgtacgatgactactatcgtctgttggatacctttctaaagaatcaacgtctcttgttctacctgactcggatgctgcccggtttgctaaccatggagtatagcatctactcgcaccatctagccgaacgggcatggttgaccatctttcatttcatggagggtgactctatgcgcaacgagcgttgctactttttcgtgcacccactgttggccaaactaaagggtcacaccatggcattggctcgtatgatctcggccctgttggaggcctacgacactgagctctcgtacgacacggtcaaagagtgctacgaacgcttgtcgtttgacaccaacaccgacattaccgaagagcccatcatcgtggcgaatgcttgcattctactgacgttgatgggttcgatcatggacgatcccataccggtacagtccgatgccgaactgggtcaggttcacgaaaacgcacgagtcttgtgcttttccctattgcatccggaacgatcagtcttgtttgcggccaatggtaacgttgtaggtttcgaacagtctggcaagggtatcggcatcatcaagggcaatgttagtctggtagagttgcacgatctcgacatgactggttttggagaaatggaggactatgagggattggatgaggatggggatgagaataatgatgatgatgccaatataaacaattttcaatctaaaaataaaagtaatataaatattaacaataataacaataataatactagtcttggtagtcctaaaccccccagtagaggcaactctccatctaaaagtttcaattccaatccaaacactggtgccagtcccagctctagtagaaacaattctcagagtaaatgcgtaaccgattgtagtcaaaccattgtagattcggacgatgccaccttcaactttatcaacatgggccgtcaggatgaggttgatcgtttgatgcaaatatacactaatctcaccgaagacgatgctcactttaagaacaaactaaacctatgggatcgtgtatggtcgtacgtgtttcgtcactgtcgacccgaattcaaacactacaaagagctctttgttttcctctcggaaacgttcaagtacaacgagcacgttttgagagactactttatgtacacgtgctgtctataccagccgtgcaaggtgcaaaaacatatgaatatttactacggcagtcccaggtgtggtaaaactacactgctcaacttgcacactgaaatgtgcaacgacgatgcaatctatcgaacctccaaagagtacaaggatgtaaagtcatccggtccctcgcccaatgccatacacttgaagaccaagtacatttccatcatcaacgaactgagctcgatcagtaacaatctgctcaaaacgatgacgggcgacgatggcaccaacgatgaccgtaccctgttttcgaccaagtttcccatgttgagcagttgcacctttctggtggcagcgtgcaatcacttgccgtacatgaccatgcccgatgaggctatccgagatcgaatcattatattcctgtttgagatgaaggccaccgatgtggtcaaggatcccaattgtatgctaacctttgccgaaaactatacgtacaaggagcaaatggaagtgtccaagatggcaccgctcctctccaatctgctgtacgtctactttagacagcatcgcaacgactatggtatagtttcgccaaagtgcatcaaccgagtctctaccaaactgttgtacgagtttatgttgaaaaacaactatctgtacaaggtgttggacatgtgcaacattaaagtgatttcaccgtctcagtccaatgtggccatgtcgtccacctcggtgcccagcatcaacgaagaggacctcatggccaatgtcagtctcaagctgattgagtacaactcggcctacaacaagactatatcgctatccaagtacatgtccgagtttaggatgcagtttaaacagttttacaatgaacacttgaagcgctacattggtataggtttcgaagacgaagagggttcgtgctatggcataggcggcaccggtcactatacaaacaacgccaacaatagcaacaagagcgcttcgtacaaaaaggacgacgacacttggagtgatttaaaatccatatttcagattgagtacagacagggcggccgtataaatgtgcgcagattaaagcacgaaattggcaagcactgttcgattacgatgagtgaaaagattgtcgattacataagtgacctgaaacaacagcacgagtacgatcccaaaacaaatgaattggtaaatgtatttatcaaatttaccaatgatgaatctggagagtcggcgttttagtttaagtttgatttgtagtctttaagctttgtaatcttggtattccttttcatcaattgtcatttattgttttcctagcacccaataccaaattgtgttcattctattgttactaattgtactcgtattaaagactgaaataaaaataaaaatcaacctacatacatacatacacatacacacatggccttttgttttgagagaaaagttttactaccaaggatattatgtgtgcatatgtgctatattattatatatgttaaccttgactcttgtaggtactttataaactagcatttttctagaatttttgtacttgcttagcatttaattttgcatttggtgtggacttttttatagctataattttatatagccttatacaggtttgtacagttttatatagttttatacagtctcatgcagacattccaagttttaataaaactaaaaatgataaacttggaattgttaaagttttcgagagaaggatgatgatgtaggtatactagttttaggctttagttgtatttctgttttttgtttgtgtgtttgttttttgtatttctgttttttgtgttttgtagttttaataatagtaggcagtagtagtagtagtatccgcaacaaccagtagtagtggtaggagtagtttaacgctgcagtattatacagtaccggtcatcacacagagtgccaactggagcacaaatgaaattatatggattatggaattgtttgtagagttaaactaaagtgggtggtttggggtattgtattttatttttgttatttagttttattaattgaagaaacaattatataatacatatacaataggtttaaaaaatacaaaaagttgaacagtataactccaactgaatgaaactaaaacttgatatttattctatacaaatacacggctacaggcagactattatactacatcagactaggtgcaccgttaggctcctacaatgtatttccacatgcataattcatcaaacgccaattactgaaattactaaaaattactagtgcaattatagactactccgcctcctcttcaaattatacaattgctttaatacaacaacaatttaccatcatcataattcaaggtaacgtgatcgttggccagcagaccgtttccgtacaatcctccggtggatcccattaatcccggaccattaacacccgaaacggtgcctataattttcaacgaagagtgcagtgtttgcacattcttggtgccgaatcccgagtgcgtgataaagcttcgcacctcagagtgattcggtccattttccaaaaagtgggtaactgcatgatcggccaatataaacagtttgtgcagtatagaggtttgcttctttttggtgagacgatccttaaactcgatatcgtccatttggcacgtacccgtgtagctgcccagggtgccgataaacttgctctctgcgattggtgcgtcgtcgacctttccaccaaacaggcgctgtatgcgttcctcgcacgcagagttgtcgtacagtgcgtcctcttgctgattgtaaatcttgctcggtttgcttacttttagtggaatctttttcagaatatcatcgaccgtggtcgacgagatgtcgctctgatcaaacttggaatcgaataatagagtcgtgttactctccgatgccaaatagtcttgcagcatagtatcggacacgtatagcgcagcgctgttatccatgcgataaactagaattgccgcttcggccatcaaaagcggaccgtgtacgatgcatcggtaaaagttgctcattagaattttattgtacgaaagtataccgcacactaaatgtgtcaatatatgagaatgcgttgccttgttgcatagatcaaagccctcttctcgaatgtagcctatgacatcggtcagacacgaattgatgtattcaatcagatagtcgacgggattgtttgatgttacaatttggtacttgttgaagcctacataaaagtacgtgcacgactgcggttcgactcgtggctcgttcacttccaaatatgtgtttaaatccttgagttggtgtcgctttcgttttctagacaatgcgaccgccatcgtgtattcatcaataatgtgcacttttagacactttcaatacgctattgtagctgcattgcataaacagagttgattaaataaatgcaagacttttaataaaattcttacacagtgatgtacaacagtgttctgaatttcagtttgttcacgaccaagggtgctgacggtcgcgccccgcaacaatagtaccggaccgttactaatgtaccggtcatagtgctgctttgatcaagttggccacttgtttgattaccaagttttagacacgcgcgcgccttcaatacactagtagcaaccgttcggcgcgcgtgtgctctttgtaatctgcaactgatcacatcctggacttgttattgttagtattagtagtgcatcctgtgtgactaaaaaatacctaacattgccgcgctttaaaagtgccagcggtcgcctgtgggaatcagttcacagagagccttacgccgagactgaaggggtttccttttacccctctctcttgaattaattactataccgtagcagttgcttttgttgttattagtacaagttttttctcaagttttctccaagtttttccaagtttattacactctcagaggatggactctggtgccaaaactttaaattccgacgacgagtgcagtactggtagcactagtagtagtaatgtgcaccgaatcaatctggacagcaaacgcattccgtcgtattacaagtttaaaacttttggctcgtgcgacgacaatcaagtccagtgtatagacgttgtgtgtaccgaatgcaatcagacggcgaccgagtgccatactccgataatatcaatgtcgacgcctgcgatgaacactgtcggtgccgaaacggaggaggaggagactcgggtgccaccgccggagcttacatcgtcggtggcggcgtctgctgtcgactggctaaagaggactactactcgcaaggaatggatcgcacgcagagaggtatcgtcgctgtttatcaaatcaatcgtggcatcgctcattgcgattctggtgctgtttaccatcgtcgtgctaatgactcggatactcttgatggattcgttcgagtacgagttgaagtttaaagatgtcgattctagttttattgcaaacaattatcgcaacggtggcgtagtgcacactggatccgaaactggtacttttgcaggtttggactctactgctactagttttaacaatagttttaatttcagtttaaataatcctaataataataataacaatagtgccacactaaatcataaccatactttcaacgctaccaatcataacaatgcatcctatctagagctactgtacgcaaacggttccaattttatggatagaaattttatggacagaatgatgcctagttttattgatagattgtctagaaagccggataccggttccagtttcagcgaggccaactttaaaaagctacaccgacgtcttagtagattgttgcagacctatacaaaagtaacactaaacttgatcatggatgatattcaaaagagtatgcattcgagtttaggtggaaatttaaatggtatgggagggttaaacagtatgagtagtttgaatgcaaactctagcagcgtcaaacaacccagtgaacatgcaatctttagacgatacaggcgtagtttgaaagatgatgttgatggggaggctactgttgatagtgctaccaatgttaatagtactactaggaacaacatcaacaatacgagcaactccaacactagaaatactaggagcaatagaggccgatcagatgccaaacgtttgattcaacaaaacgatttcagtaggcgtagcgaaaagtttcagttgaacgttagagatcaggaaacgtatagttttgacggtcaacgcagagttgctgtaaataatactaggactgttgcaacttcaaactttaagagactcaataccttaccactttctggcaacgctagaccaatctacactagaccaattataaactttaaatccaaagttgacactattccaaaagtcaatggtaatctacccaatactaaaactgacattaaacagactaatacatccactggtaaggcacatgctaaatctaccattataactgtccaagttggtacaaacactaaaaatacggacaataaaacgattaatgattccaaactggatggattaaattcaaactttggcaagcgtattaatactgctactactaatactaccaaatctataggtagtaaaattactagcaccactgcatctataatgaaacaaaagacgactacattattaaagaataggattcagactacagtaaagcctaaattttacaccaccttgaagagagctaaaactactgtaaaacccaggccgacgatgcctactctgaaacctactctgaaaactacagtcaaacctactcttagaactacaatcaagtatactcttaaaactacaatcaaccccactattaggacaactctcaagtatacactcaaacctacgatcaagcctacgcttaaacctactattagatctactcttaaaacatctcttcataaggctacaaccaagcatgtaactagacctacaatcagacctgtaactaaacctacaatcagacctacaactaagcctacaaccaaacctcccaaacatacaactaatcctcccaaacctactacgacactgaaacccaagcctactctcggtaaacatacactaccaacactgaagccgttgcctactcttaaaccattccctaccataaaaccattgcctactatcagacctactataaaaccattacccaccttgcctacactgaagcctttgaagccattgctagagatattaccaactctgggtccattgttgacgctgctaaataaacatacaacaattaaacatacaacacctaaacacacaacaattaaacatacaaccagtactagcaccatacctacaaccaaacctaccacaactaagcatcccacaactaaacctcctacaacaaccaaacctacacttgcaactacaacacggctacttacacaacctcttacaccgcctctcacacaaccaccgaccacaataaatctcacaacctttaaactcagtcctacaactttaaagccaattccattatccactctgcttgaggatttatccattatttgtaaacctacttgcagctctaaatttagtactttacatactactctacatactacgttgcctactactctacatactacgctgcatactactttaactcctactaccactttacataatcatcatgcaactacaaaaacaaccaaaacaacaccaacaacaaccacacctctaactacaacacctctaactacagcaccttttaaacagtttactacactcggaagtagcaccctaaaagcaatttcaaacggcacactaaaggcactctccacactaaaagtgctcgtacaatcaacaagtgttggcactgttcaaacaagcactgtaacagattttacaactgaatcaaaggctgccacagagcctgaatcggtcactagagtcacacccaaatctgttgctattcaccaacatgttaccatcccaaatgcagtcaccaaaggcaccactcttgaatctataaatgtgtccaataccgagtctaaatctactacaaaaataccccttcaaattatagagccattttcacgtcgcacaccaaatgtgacaatattgaaaacaatcctccctccagaggttgcacggagccactcaaacgttacactattgagtccagtaaatgatacttttaattttgacgatgcttttcattttgacaactctataaaccatcctccaactttgagctccattttaaattttacacttttacaacccgtaattttgaatccaataaatggttccataaaaactatagacgagatgaacctctcgagaaatgataaaactttaccaactctacccactccagtgatacctatatccactagtacaaaggccagtgtaataatggttattcccaaaaagacgaccactgagaatcctctgaccaccaagtcggccaatggaatacttgtaaagtttgaaccgctaccgctggagccaatagttactagacgcaactttgtaatggatactattccaactgtgaaaattcctacaactaaaatgatcaaaaaggtgccgggtcgtttgtacggtggtggtccatctaaacgttttcgctccaaaacaaagtctaccactagtagtagtagtggtggtaataaacgcagacctaataggcactaatggtaggttgtatgtatgaagccaataaatgtttggaatttttaaaagtactttggagcactttaaaaaggtaatcattagtgtagttaaagccacttgtattttacagcattttaaatgtagcgtgtaaatgtttagaataaaatttaatgcactataataatgttcaacatcaatatcagcacacggaatctcaatgtataaatgtttaattaaatgtttagcttgtatgtactaaaagtcagaattaatctatagttgataataaataataaatggccaacattttgtgtccaagatttccaagcctgtctagtgttataactgtctactttaatgtttactgtttactgtctagaatgtttagctttgtattaaagatgtttagtttaatatttaagttgtttaatatttaatgtttaatatttaatatttaagatgtttagcacacaagaagtttagcacacaagatgtttaccatccaagatgtttaagatggttattatttaggattatttaagattatttaagatggttaatgttcaagatgatgtttagtattatggatagtgttttaatatttaacatggttactatgattactatttaagaggattaacattaaagatggtttttaaagatgttttaaactgcacttacattcttgtacaaccactttcaacttttatatgctctataactttactgtatgacattattttgtattatattgcattacatattttgctttaataaatggttacaatttacaatgtctcgtcttttatttagactgtctctggtgtaggtttgttggttaccctaatattatttagtgtaggtaggtgggtttggtagttggcccaatattatttagtgtaggtaggtttggtagagtacaacttgatggataaaggtgatgaaaaaagtatagactctgtttgactaaaaaacaacatttattagagtatgatataaagatgtaataggaatacattagagtaatacattagagtaacacacctataacaacacatctatcatatatatctaaacagccagaaccatgggaatcttcgggtatggatcgtaaccttttattataaaatcttcgtacttaaaactgtcaatattttcaactttacgagcaaactccagcttgggaaaaggtctcggctcccgttcgagttgcacctttaatggctcgatgtgatttaaatacacgtgagcgtcgccaatggtgtgtacgaactcgtgcgctttcaggccggtaatgtgagcaatcatgtgcgtcaacatagaatagcttgcaatgttaaagggtacaccgaggcccatgtcggcactcctctgatacattaagcatgacaatttgccatcgtacgagtaaaactgagccaaacagtgacacggtggtagtgccatttggtgcaaatctgcaggattccatgaacacattacgatcctcctgtctgttggattggtcttgagagtgtcaatgattgtctgcaattgatcaacaccctgacccgaatagtctgtctcgcagtctacatacttggtgcccgagtgtctccactggaatccgtacacgggtcccagatcgccctcttgtctgtcggtgaagccgagcgaatccaaaacgcttcgactactgttgccgctccaaatgtgtacaccctttcggctcagctctttggcattggtcgatccggaaatcatccacaagagctcctcgatgacgcccttgacaaagacagtcttggtcgtcaacagaggcagactattgtccctcaacgagtaccgatgcatcactccaaagtgagacagggtgcccactttggtgcgatccatgcggcgattaccagtttcaatgatacttctgatcgtgttcaagtattggtgctcttcccagtttgtctgcattgtagtaagtatctatctcttttttagagttgttaattaatttttacaactacgagttgtaaatttattttccacttgaacgctaagctgtctactttgtagtgcaacgttgtacctgtgtgtatgtgcactaaaagaaattcttacttcaacttgtaaattttaaatctacttaaagtacctctactgcaaccagaatgcaactaaatgcaaatggacaaggcaatttatttatatagtgttccacctataataataccacaaatgataacactaatagcatatatatctacaaaaaaaattgaatttatttacaaaaagcatacatgtattttatttcatttcatgttattattacattttattatttactactacacttgattggaatctacacctaccgcttattcatctgcaacgacactagacgatcgagccattcctcttctgtcggtttggatcgtttgatgcaaggcttgtcggcgatgggggtgctgaatgatccagtgccagcactggtaccctctccagtaccagtactactgctactaccattattggcatcatcatcatcattgccattgttggcattcgacatttccaacaaattaaactcggcatcgaaatcgtcatcgtcacccgttagcagtgaaaacatcctagatgtgattttgtacaatcgttcaaacgaatcgactccgctgtcgactcttgcatgatcaaacacgggcaactccaacacgttggccataaagatgtacgcatggtattgagacgctacgtacttgggaacgagccccttgtagacgtcgcctccggcaccgcgagccaccatcatccggcagactctttcaaagtcggaattgaccacaatcaacacattgtggttttgggccttgataaactctagtaccggctccatttgatgcatgcgtatatagtttacgcagaggcagtgcggcgacagcttttcatacatagagtcctcgcacgacatgagccagtagactagttgaaatgtcaaattggatagaatcgatcggtcaatgatgcatcgtttcatctttttgtagtttagagcctgtttgagcgcatactgaaacgcagtggtcgaattgaaattgtagtctttgcactcgagctcgctgttgatcttgtaagcgcaggcggaatagtctttagttagacgatttataacggtactctttcccgagcaagacattccatcaatacataaattgtaaaagtgtctattgttaattattctctcgacgaggtactgttcgctgttggtcaagtctacgttgggaatgctcagagtcggatatttttccagtaatctatgggacagcgcatcgtcgactacgcctcgcttgcccagttgagagttcaatagtctcagcatgttgcgtttgtattgtaacaaccattaactggtaaagtcggcttgggtttatcacacataccctattagttataaaacatcggcaacttcataaagttgtacagtttgatacacaccgctgtgcggtatagtacttgttcacagtgataataccagataataccaggcaataaaagccactagtagcacctgagagcatcatttgaggtctagttttatttgtagacacatcatgcctctagtactccgcaaccagtattggttcaatagcaaagagttggccgacgcgtttggctctctgcgtataaagggactcggtccgaatcatcgcatgtcgatcggtcacaatgaattcattagctaccaggggttgacgcgactactcaagcgtaaaatcaaacagagggattacactataaagaaattgatggaggccgtactcgccatggagaaggcatacatcaaagacggctcgggagtcgcgaatcaaggctcgaccgagatgggtgccgctaacaagtccgagtgcacaactcagacggacgccgttgtccgtgtcgatcagtgcacacaaaccgaagacttggacgcgctcgaagtgtttggtttcgatgccaccgaagagtgcaaggatgtcgatttggacaagattaacgtggacgattgcatagagccgtgcctgaatctggcccaagacatggaagatttgttcgagtacattaacgcagaggttcaatccgagtctacgtttatggactcgccaaagagtctatcaccggcgtttacgattgacgacgatgactttatgcaaccatgcagtggcaatgtcaatctaaacactataattgaacacttggacgaaatggagggctctttggtggagggtgtcagaatggaggaatctctagagggcccgttagagtctatcaaggaggcctgtgttgacaatgttgtagaggtagaggctaatgttggtagtagtagtagtagcagtagcaatagcaatagcaatagcagtagtggcaccagtagagtagatttcaaagtagatgccaacactgagcctacaacagaagcagattccgattccaaactgaatgtagagatggacgacgagccacagggaccgtttaccagactgaggaagaacagacgcatccgatacagacccaccaaacagactgtgcccggacgattcaagagcgaagatcgctaccttgtagtgtaccgcaagggtagatgtggcaaaactctgggctgcataatgggcaagggtttctatgtgtacaacaagctgaatcaaatgaagggcaatattgagatggccgtacacactcggttggacaagagcttcaagtttgtgtggaacaacattatgaaagagtacagtagacatgtgaatcgtacggccaatgttgtcaagaatttgatcaagttcaagtctacaccggaggttgacgatttcataaactttgtcaagataaagctggagcagatgggtgttaaacattaggtggttgtggtgctcggattttgaactcgttaaatgttggaccatgtagacattagtagatattagtgaatattagtggattcagtttagtttcaaagtggttgttaaacactagatttgatggttgtattttgcaatataggggatagtttagtatgtgtgtggggtggtggtagtttgtagcagtttgtagtgttgtatattgcagtgtattgtagtgtattgtagggtaatatattgaagtgtagtaaattgaagcattgtaaattgaagcatagtaaattgaaacatagtaaaattggtgtaatataattgtacaatataggtgtagagtgcacgtgtacaatatgtacaatataaatgtttaatatggtggattaatatagtgtacaatataaatgtttaatatagtgtacaatatagtttaatgttggtatctaatactacaagttgtaatactataaagttgtgagataatttaaacttgatgttcaagtttaatgttcaagtaaatggctgtaaactaagagttacactaaatgtatccatagtactactaaatgtatgtaatgttgaatatcttcatagtaagtaatactaaatgtatttaaaacaagaataaatgtgtttatgatattttttaataaatgtacattttgaatattgtagagtcaaagactgatgtgctttatacataggtctgctataaaggatataaatattacttgatgttaatgttacttgatgtttgatattttttgaataggttgtagtttatgctgaataaagtctattctagtttaaaagaagtgtactcgtttctgttgaatccaaatctaaccaaggctctacagcccatcttaaacactaccaatctccaaacattttacatgacactcaaacactgataccttccattataaacaactccccatcacaaacaactctccatcacaaacaaccaatacaaacctaccaacacggccactctttctaccctcaatcttctaacccagtaaccttgtacaaagtgtaaactgaattacattcaatacacactaccactactactactacaactactacaacaacaaactaaatctctagcatgtaaacaaaatcacaactcaagtgcaagagcctcagtccaagtgtaaaagctgagcgtataataaatgcaaacaaagccaattaaccaagtgtgcagtgcactcgtaaaactataagccttcttataaaggtgcacttgtaaaggtataaaattacaagactacgtaaaatcataaagaacaagtgtaaacatacaattcagtgtaatttattcaatctaaaaaacagcttacaacttacagcctgtataaagccaaggtgttttttattggaaaaagccgagtttctaaaagatgtttacattcaactagaagtaggtattaaattgaaatggagaattcaccgttagatattgacattagaaagccctcggatctagctacaatatgtatagacaggaagtgtttatgtaggtaggccttttgattgacaccaagtctagacacggcgtttctaatacaatgagagtttaacattgtaccatactaaaaaacatgaatcatggattacaaagtgtactacatgtttacatgctaatgcattcaaattaccaatactggcaattgcttcaattacttgtttattgcctgctaatggtaaatttactaattgaactaatcaagcaaatggtcaaatgtaatgaaatctctctctaaatctaacgagtctaatggattctggaaatgcaaaagtcctctacctatggctaattagtctgtaaatctatttgattaattctcagagccagaggttagagtccaagggatccggttgtttaggatgggatgcttggatgcaaaaaagtagactagttggattctaaaaaaacaagagagaatttatggatagatttttattggtttattatttgtttaatatttatttatcatttatttattagttgtttatacaagtacaaagagttgtagagaatctttacatgctagtacactacattacagtacagtacactacactacactacactacactacatcacctaccaacaaacaatcacctacactcgtttctgtaacattttaacaaactcgaatcgactacgattgtttttgaatcggagtactctgttcttgatcaagactccatcgctcaactccaccaattgattccacaaacctatgggatcacacaccttggccgatgcaaagagtttcccattgttgatgcgtttgagtttgtagcgcttgcatcgattcttgtccaccacttcgaacaagactccgttcggctcaaccagatggaatcgtacaaagtgtgccgagtcatcttgtcgtagcgcgaatcgtttcacgccatcggtaaagctcacgtccatgagcggacgtaatctttcctgtttaacatcaccgcacaacacgtacggcactcgttgaccggtctcggcatcggtgtacgtgcacatgtcgatcggttcaaacttgtaaattgaatcatggccctcggatgcaaaacagtcgatgcgttttatgagcgagaccacatagtcttgcatcgcactctggtcacccttgaatgactctaaatcgatcaggtaaaagagatgcggccatctggcgtgcagagccacatatgcaaagtattgaatcggcatatagtgccaccactgggatcgttccacatcgcaaccttcttcacgggctcgcaatcgttgtgcggctcgtttgaaatccgagtccaccaatataatgttgaacgacaacatggccatggattcgataacgtccgagtccaggtagtcggtgtatttaaacatgtgtttctcatcaatcgtaccctcccgttcggctcgtcccagcatgagccaaatcttgttccacatgagcgtgttgaaaggcaaacgatcaaacagagtcaccgagccacccttgtccgcctcgatcattgctttgataaaattgaacacgtacgccatacacgagctgggatgcgagttgcgcgaaatcaatctagagccactgcccggcttgagcatcttgccgtcgagccgggtggcaatggaggatttacctactgcactcatgccatcgatgcatatagatttagtggttactgcactctttttcaacgagtccaagtagactcggttgaaatcgtccaattgagcaacatcgacaacacgagtctggtaagctttgtacaagcgatcctgctcattttcatagtctggattcaacgagtccacaatcggattcagtttggaaggatgaaacgcgacaggcgaccgaacatcgaacaattgaaggatcgagttcattttcattatcgaactcattgttcaaacagagtacaattctacataaaatgtcacatacttatcgccaataacgtaaatgtgttatcaaaaatacgtttattgtatagtgtgcgtgcttgttggttgaaacttttttcataggatgggtatttaaggagggttctgttcgaggtttggtcattcggttgtgaaccttcattttgtaaacatctgccaaaatttggtcgtgtatacaaaaactacctgcctttagcatttataccagatattttaaagttattttaaaatattctgaatcccataccgagagtgtgtatttgcatttatataaaaacactactacctactcgggaaattcaaactaattccatagtggatatttatatataattcagtatcggtgattcagccaaatcaaatcaaatcaaatcagtttatttgctctaaacatgggtgataatacaatgttacacagtatttatgatgttaaaataagcagtatagtccaacatgttttacctataaaggtgtacaaattaaaaaatttcattaaagtcaaattaaaatttagtcccaaataataataataagtaattaatgtcatgttaagaataattatacagtacagattgttataacaaatttaaaatgagtcattcaaatagtcctttacattataataacatttgttcactaaaatattctttaatctttttttaaacaacattatattcaacgtttttagttctgttggtaatatatggtaatagccagtggatattgcatccttgttgtgaagtgtagtgtcacttgctgtttattacatttgagaatacctactgcaaccatgtacaaggacaacaagtacggcaattctggctacaagggtagctacaacgcttacaacactggcagtagcagtggctcttctggctacggtggaagctctggttccggatcgggtgcgttctacaagtcgggcatcactctgaccaatagcaatggcggcaacggatcgagcactggtagcagtggcactgcgttcaagagctatagcagtgcgacaaatggctacagtgccacaccgtctgtgcaacaagttcagcacactgttcagaagcccgcaactaggagtgtagagacgcagacttatacgcgcgactacaccgagaacaagtatcaccacaagatgaacttttggcaccacaagcccagcagcggtggatcttcatggagaaagtagagtttgtagatgtttaaaatttagcgcggtgatggaaactggggtaactcttaacaaactttatagatgaactcttttatattttatacagaaatgttgttataaatgtataccgatggttgtaattagtttttaccaactcttaccaactcattgttgtgatgccaaatgtggtgccaaaagctgtagtacctaactaattaactaatagcaaaactagtaacaaatttgtagtagtgtaacgattttatattagtattgtatgcatagattgtattaacatagattgtattagtatgttttagttttttagaatctcaattagcataatatttttaatggttaaaaaatacaaatctacctaaacatgtctccatctttagactgtactgtatttcaacaattctattcaatgatggcaactatcctgcaagtgtattgctaaaacttttcgtgtaggcacttacttaattttagctctttctacaacaattgtagctcttgcaatctacctacttactttaacaataacaataccaataatgtttagttatttaatcaactttatttttacaaaccaagctaaccaacgattgtgattttttttgaataccataattttacaaacaactttacatgataattttatttacataataaatgtttatgaaactataccaacctctttcaattgatatcccaatacctgttttgtttaaatctcacctgatggacactagtacctaccctacactacaaaatttaactattaactatttctaaaagcactcttcaagtcaaacgcctacccttacattaatggcaacgcaccaactcctacacttttagtgctcgcaactcgcacgtgtacaaagtgccaatactttcacggtggatggtttacgattatggtctgtttacaagctgattatgactttgcgcttgcatgctaataatggttcagtttacaactctatacacgcaacagtctaattatcatagtaatccttggtaacgattgaattcaaaactgccgacgagtcgttggcatctttataggaccctttatctttaatgtaaccaccgcctctgcgagtggtgctaaacggttcgttgcactcatcttcatcgtcatcgtcttcatagtctccatcgtcttccgaattgccagtgttgcagtttacgaccggtgcatcagagtccacgtttgaagtcttgattatcaaacacggatgcatgcactcggtcgtctgtttctgcacctgggaatcgggactggacgtgatcaacgaggccagactaatgtgccgattgagctgatgcgcagtgagtcggtactctttggcgttgcgcgaacgcttcaggttgtaatagtgccaggcaccgtggtcggcaatcactgtgagcaagattagtttatcggcaatgtgcgacggtagagttggcatcccatcggccaaggcgattccattgtttggaatcacatgaatctgtttaatgcgcacattggtgttggccaactcggtagacttgcacgtattcgaaccgatgatgcccttgaagagatcaatgattacgggcttggaaaagaggtgcaccacggtgcgatcctttctagtgtagtgcatgatgggctcgtgatcgtgccactctatgggatagtatgcaatggttgtgagttcgcacagattacagtacatggccagtagaaacttgaaataggactcttcaccgaaccgatcgggctcgagcaacatctcgtttagcatgtccctggtcaggcaggagacaatctttgacttgaccaaagagtctatcgactcgtgagaatcaacgctatactgacgattggcaaacatttttaaaaaattacagtctgtaatgtttgaccggtacacactcttaatacggtattggtgtttagttgtaactgcgtatatatgcttgagggaaatcatttcgatgcaatagcgaggcgtgtgtaatatcgaaacagctcatgaatttcacatttatatttgtcgccgtggtcgtggcgatactagtcaacgggctcatggtactctactaccacagcaaatggtactcgagttccgatgacaagtgcctagacctgggtgcacaattgcaaaagattgaacaagaggtgcagactcaggcaaggatgcacagtgcgaccgacaaagacgaggacatggaaaactattttggctcgaggctggccaactatgtggaatcgtcagagttggcatcgtacgccaacgccgaggaagtgcaccgagagttggcaaagcgcgatagcatccttgccgagctgcaaaagctggtccaagaacacagagagtcgaccaccaacgatgacaacgacgaacacctcaagcagatgcatcgagacgtttccatattgcaacacgccgacattgacattaacaatcgcatgtccaaactacaagtcaaactggacgaactacaatccacggtcacggtagatgtcaatgaaaagatcaagaccgaactgcccaagttgaaacaagagctgcaaacggtgcacgtaaagcttgtggacgcttgtcaggttttggccaatgtactcgagcagaacaacaatctgcaaaagtcgtttaataaactcaaagagtctacggatccgagcattttgggtgatcagttgacgatccgactgcacgagtacattgacaccaatctggaacaggtcaacgtacagactcgatccatacgcgcgctattcgaagagcacaagaaacaattgaccgacagcagcataatggacgacggtgcggtggcgaagcgcatcaagtccctgtccgatgcgctggaccaccaacgcgacgagtacgagggcaaactggcagaggttgcacgctctcgagacgaggttcaggagaaactcaaccggctagactttctaggcaacctgaacaatattagggatttggcagcaaagctagacaccgagatgggtttcaatacgcgcatatccaccatcaacacggcgataaagtctattcagatcaatcacgaaaagtggctaaagcgagactttaaggctgtgggcgatggtgtgacggacgacaccgaagccatcgaggcctttatcacacacttgctcaagaccggagacgtgggcctagtcgaagccggctcttttctaatgtcaaaagctgtggccatcaatagcgacgaagagggtcggccctttaccatcaagggtttgtcggccaatgccagcaaggtgactggacccggaatgctcacgttcagagactgtaaaaacatgaacatagagtcggtgactatggatcgagtcacgatggtgaattgtgacacgtgtcgctttgaaaatgtagccttggacgagttgaccatcagcttcatgtccaatgtgcagctgaacaacattaccgtagactggttcgcactgagcaacgttcagaatgcccgcttggaacactctaccataaagaatctcaaggtggtggaatcacaaaaggtcctactgcgctccatagacgcgtgcaatgtaacctatgaaaactcgaacaattgcacctatgaaaatagccacattatggaggacggtctggtcacggtgcgagactgcaaactggtaatgtttgagaacctcttctttgtgggcaacggctttgatgtgttcgactgcaagtacttgaccatatcgaacgtcacctttgtggtgtcgtccagagagtgcatcttcatgcaaggctgcgagtttagcaagattcaaaactgtacaatgcacgatgccgagtgtgcaatctatctgcaagagtgtgacaacttgcacattaacaacattttggtgtacaatcaaaagattccagccaaggtggtctttcaggtcaacaagtgctcctttatagattgcaaagacttgagcgtaaactcgtccgatcagtttgatccgttgacggtgctcgtggacgtagtggacagcgattcgtcgacctttgcgttttcgcgcatcatcaacgttcgaatcatttcgatccgtcccaattgcgaagacgtgctagtcatcaagcccatacacgaaatcagttcggtggacgagcaccgtctagacgtgatcggagacacaaacgatgtatgctcgtttatgaccatatcaagggtgtacaagtctgattcgtacgaacgcgaagacggcagaaaagtcaccaggggcatgcgactgatagaggccaacgaggaggacactgacgaagcgatcgatccggacaaacccatggtactggagcccatgtaccgcagacggggttcgattgacgacaattcagagcgactcagtgcaggcagaggacgtggaagcggcagactaagtgcagttgctaggatcgatggaatgaagagaaatggtgctggcagaggcggcagtaacggtgagggtgattcaatcggtaaagacgaagagcttgataccgagtagtatgactagatgagattctagtatatgcatacgtgcatgcattgcgtatactccaagttgtacaattgtactacaaaaaagtatactcaaagtgctactgaatcaaaatgtgattatatgcaactgacgaacaaatttagatttaaggcaaccggtgcagctagtaaggatttccttacaaggatttattttataaggaactttaagacttgagaatttatgatattttatacattccttttaagaatataatgttagtttaagatttacgttacagtcttccattgtgtttgaatggttacattacttgtttgaataattgtaatgttattcctagagtattatcaaggtgtgggtttaaatattagtcctagagtattattcctagatacttgggttttgtgcaatttgggggattgtggttaaaaaataaggacatggcaggtaaggttgtgtattactaaggttgtgtattacatcatttgttgtgaaccttggttgtgtgcatgatgataaatttggattattagtagtagtagtagtggtagtagtagatagagtttttgcatgcttttacattttacaaatcatggtggtggtgtattattattgttgtgattagagtacatttataccttagtacatttatacctttatacatttataaatttatacctttatccattttacatttatacattccatatactcattttattttacatgtactttttattttacatgtactttttattttacatgtactcatttttatttaatactagtacatctttttttagactcttaacatgacttcaaagaaagagttcaaggtggaggtcgactctgcacctccatcctataaacctacaactgtgcctacctcctataaaactataactgaacctacacaatataaaaatacaacaacccctacacattacaaacctacacaatatgaacagaatcaggatcgcttgcaatttgtcaaattcagcgacagtcacattagagccatacgttacgcgttcaactttttacaacgtgcaaacgagtctctgcatccgggcactgagcttgatctggctcaactcacagccgaacagttggccgagttgctagtctctcaaaaggacaagtatcgaaacactacaatcgtacagatcgccagaatcgtcaagtccttggatcgggacaagtatcgcaagatactctccatgattattcccaaggtgggatgggtgcgaccaaagcgtacggctctctacaaaaagatggacattgtcacacacaatgccatcgagcgtctggtgctggacgtgaccggtgaaccgtggctgtaccccgaactggccccgtccatcatactgtgcatctgtacaaatttgcgtatgaatgaactgcaacagttgactaggaaatcgctgatggacattgtcgaaggccgcaaggtaaacattaaaatcaagaagcgttctcgcttcatacgagtcttgtacatacgtgacattctattgaaattcctagactttttaacgagccacaccaacgaggactcggaccgaatagtgaccgtcagtcgatccacattgaataaaatgctacgatccgcactgttggagaggggtgcctcaccggatgaactctttggcatacagtcgatacgagtgtttaatacgacccgaatgattgccaatctaccgttgggtctggtggccagattcaatcggcaccggaggatggagactacatcgcacttttacgattctggaaatgtggtgtttgagaaggagtttagagagtttgtgtagaggattcatgtagaaggatttggaaggtttatgtagaaggattggtggaggcgtatgtagaaggattggtggaggtttgtatgcatgtatagagagatttgtatacactagttttaatttttttatttaaaaaataatattatgttataatatatatttaatgtaatttagagtttaaaaaaatgcatcatggtacaatatatgtatatttttttacaatacttgtgaattcttttatttactaatactattcttttatttactaatgctattcttttattcactaatactatcctatagaaacctataaactcctatgtaattataaactattctaaacaactctaaacaattctatacaactctacaaatctagacaagtctaccatcaactccctacaaaactgtagacaaccccaacgcagacagattcaattgctgctgttgattctttccctgcttggctttgataaagggcttaatgttgttcagtacatcaaactctgtattggtcttggcaaactgtacactgcgcgttgacttgctctttttggtaacgtgttcactgcccatttcaagtgtacgcttcaggatgctctttggtagccggttcatagtggccggtggctcgtccattgactgcgagtcggcatccatgattgcggtggcctttgtcgagcccatgattgccgagtctagcttgtctggcggtggctcttgtgccagaccgctcagttcaccgttggactcatcaaagagattaaacgttgaatctggtcgggaatcgtcttcgttcaacgttttgaacaaccactcgttcttactgggagcagtggtcgctttgcgctttcttgaagtctgcttggtcttgtactcttcgatggtgtttaaaatgtccaatttggccaaatcgtttgagccatcggtatcggtgtccgtatctggctctggagagattgatgtaggttctacatttttaggattcatagactcggtggatagaggtgcaccacttgtatcatcctcaaagtctacgtccatagcattagattgtatagcattagattgtagagatgcatccaccggagatgccagctcttttaccgattcttgtagctcttcaacgggtaatgattttggtgatgattccaattctagtgcagtcggtggctctaatcgattctctggtgaatttaatgactttgctgaatctagtgtaattgatgaatctgttggttttgatgaatctaatgagtttaacaaatctattgattttgatgtatccaatccctccaagctaccatcctttacactcgactctgttgcactacctaaaccatcatctgtcctaagaccatcattctctgtcctaagaaaaccatcatctatcctaagattaccattctcagtcctaataaaactatcctcaaaaccctcttttaagccatcctccaaaccaccactgaaaccctcttctacactatcctctactacactcctacgataccgtccaaacctatcgggcaacggttcaaactcagactcgtggtactctacctcgtttgtggaaacgtcatatgaaggatgggaaccagtgttgtcattgtcgagttcaaccactgtaggttcctccatcagtctcagttcttgatcagttttgggtttgagttgatccagattaatgttttcattggtcgtatcgaatgtgacctcactgagcttgtccagtaccgattcgtcaacattcttgaatatagactgattaatcttttccagattcagattgagcatctgaccaaacattttcatagtcacattatagtagatggaatgttttttggtttcacgagtggacaacttttcgatgcgatgctcaatcagagaaatcatatcgtcatcgtccaagtgaggatcaatcttggtgggatccaagacggcatcgatgccgataccaatcttggtcaaaaagttgatcacgccaatggaaccggatcgtactacggacttgcccaccgacaccagtatgctttccagcttgagctgagaggcaaaatcaaagagtcccttgagcgcgtccacatcaatctcggtaccgtagcgtttaacatagtcgcacgctattcggtcgcgctccaaccatgacatgagcgcggcctttttgtacaggttagcattggccagttttatttgattcatcttgacatgacttctaataacatgccgcctcaacgttactatcaatagctcatgtgtaaaatttggacaaaggtaaaactcggttagtttaataatacaccatcaaccttggtatacttgatgtcaaagggtgtcataaagttgcgagtctcgtacagctccaattctagatagttgcaactggtgccgttgctcagaaagtctgaccacttgcacggtaccgttttgaagagatccgtcaccatggacgttagattgaaacacttgaaatgcacggaaatgtccagtttgcgatccgtctgtgtggttcgattcacgcaaggcgtacacgtagacttgttgtcggtggcgtccgaattgtagagcctggtcactttgggatcaccgcaatcgcaatgccaatccacggcaacgcctcgatcgtcgtgatcaaacacgacccgagcatcgctgtgcgcattgggcacctctcgagtgcacggatcgttgatgggatggaatcggtttgcgggatgcggcagcactcggttgttggtggtgttgttgaacttgcacgtgaacctatacgttccggtgccgggcaccaattcgttctcgtcgtccagtgtcacggtggccgcatttactggtgcatttagcaaattgtcccacagtatactgccggtggacggatgcagttcgttgttgcatgcaatcactttggacgcatccgtaccgccaaacaggttgggatactttgatcggcacacccaagagcccagaccgtcggccaccacgtagccggtgcgaggattgcactttacctggttgtcgaccatgcaatacttgccgggtgccagacgcttgttgatgtggtaaaactcttgactgggactcacgaccaccattcggcccagggaaccgcatctcgatgtgcaatagctattgtactgcaacagcgtagtcttgtcctttggatcgagcggtgctacgaacagaggctctgcggcacactgcgacaccttggacaagtcttcgtgttgccgaacataggaagagttgtggtcgatgagcagcgacggtagattctcgagtccctcagagtttatcaatttggctagcttttcatttttggcttgcagattgtacttgttgacataggcatagtatttagagttgtctagacgcaatgtcaaaaaatacaacaaacctaccacaaagagtgttcctacaaagacgggcagcattgtggttgggggttgaggttgagtgttaccgttgggtttgattttatattttgttattttgttattttcttagtttgttattttgttttaaatctagtttaatctatagtttaaaaaataagaattaattaaaccaaagatgtagagagagaatccatttatttagtttccagtttagttcagttatttcagtttatttcaatctattcaatttcattaatattgtcatttattttcattaatattgtcatttatcaatccatctatcattcatctatctttattacacaaatctaacactttaacgattccattatttccagcaacctatcctactaaagaatgtgacttaatctaacatgtactgctaatccaaattaccaaactagactatcctaaacgatactatcctaaactatcctaaactatactaaattatactataccaaactaaaacaaactaccctaacacgacctcaacttaatctaaacacctcaactgatcatattacacattacctcttgatgtattaaatattaaacatttgatgtacaacttgcatttcaacacaacacttgatgtataccatacactcttacgcatcacatagagagcactcggtagatgtaggcagcttcaatttatgtggatgaaaccaacgaaacacagtccttaatcttgccagcagtcagcaccgtccacaatgaggccagtaccgtgaccacttccagcacgatcgatacaatcatcatggtcttaatcttcttctttttcttttccaattcatcggctgtgcttgacgtactcgaagccttaacgtcagcgttgtagtacaagtaaactgccaggaagaggatcgagatggcaaccagcaccaccgattgtatgatacccagtgcaaaaaccgtactggccagtcggccacattccggtgtgatgcgagctcggatattgttgattgcgttgttcatggtgtgtgtatgtgtatactttggtcaaccgtgcacctatcataattcacccaaatacaacgctaataacatttacgagcttcgccgcttacaccgtataatatgttgtttttcatttttcgtgtaatcatacaattcaacagctctagcacacgcacaatgtcgcacactcttagacgagcgtcaaacgaaaaattgacaaaaccctctagtaaaagattgcacacttgctgtgtgtcgaccacaatcttggactctttgaccagagcctccaattgatcgacaaagggatcgcgctcattgtttagattgtagcaaaacatggtttctgtgcacgatgcaaatacaaaaatcaatggatacatcgatgagtaatcaatgaatccaccgacacaattggcattattgtttaaaactctaacgagctcgttggccttcttgttgtcaaacgatccatgctcatcgatggtcgtaaatgtgacaaacttcatttttcaaatttattgtgtgcttagggatcccgtacacgagctcattccaagccgtgtatgttggtgtctaaaaaataaagggttgtattttgtaatgtactacaacttgaagtttttataagaatgtaaaactagagttaaatgatgaaactaaaaaatacaacattttttatttgatagaattaaatgtacatataaatgtatttactacactatcctatcctaccacttacactatcctactacatacaaactaaaacacaaactccactaatatgcaaactccacattaatacacaaactatacactaatacgcaaactcttttacatttttcaaatacctaaactctgggttacacaaatcatttgtgattggcaaatctcggtactcggcaacctttccgttgaacagtaattgtaccgaaccacctccattgtataatacatgccccatttcatcattagagtttccatagtcatcactgtcggcatccttcaactgtttaccctttagcattcggctcatggtcagcatgagtgcaaacactgccaccagagtgccaacggtcaggtagaatgtggcatttgaaaactgcgtgtccagagtgtttttgtagagctgagagtacgccaccgcagcaaacattccaacggcattctccatcaccgacagaaaggcataggctacgcctcgctccgaagcaggcagcacctttgaggccatcgatcgcaagagcggagccacacaaggtcccagtgcggccagcgtcgctcccaggtaccataggttggcaatctttgcatgagcgtacaccaagtgtccacagatgtgagccacggcgcccagcattacaatcagtgtgtcggtccatttaaagattcggctcatgattggtataccaaagagcatcgccgtaacgtacattgcactcaggtaggttctaaagtggctataggcagtcgtgtcccatttaaactctttgattgcatacatgtacattacagagcgctcgtctcgatgaaacgtataaaaggccatcgacagcaaaatgaaccacaaaaagagtcgccgattgttgggcctctttttcactagaatattcagggtagtgttgatgttttccaaatcgaaaaagtctccgagtgcattcttgaggccagcctctttgagggatttttgctctggtcgagtttgccattttaggaataggatcgtgtacaatgtggccgcaatcattagactcgtattgatcgcaaacatgatgggataggatcggaatcgcttccacagcacactaccgatcgccacaccggttggcatcgtgctcaggtagacggcatccaagatgcccactcgtagcgtgcgattctccacagtcgacacatcggcaatgtaggcaaagcacgctgcgaatatggccaaatcggctccggtgagtgcactcggaaaggatgccgtgtagattatatactctacgggccagctcttgagactgtttacggttagcattgccgagaaaaagagtttgcctacgagtccacatacgagtacaatctttctaccgcgcctatcactataggatcctaggaaaaaggccaatataaagggcactacatgactggctacaccgttccactgatgaaatgtagacacagtctgctggactcggttgttgatgtcatcgtactggctaatgttgtggcacacctctggcgagtagccatggttgacggtgcacgcttggtacacgtaaaacgcctgctcgatgaccgtggtcgtcatgaaggccatcatgtatagaaacatgggaggctccacggtaagccattgttttttatcacccattgcgattaaaactaacaaaccctactgtaaacaaccgttatctgagcaatgtaatgtcgccataattataatacgctatacgccttgtgtggcattccacaacataaggttgatacagtcgcacgtctgtcaagtcttttgaatttatgtaggcaatttcaaagtttggccgactcgacattagccacgtcataaacgtccagtttgggggttttttcaaatcgtcgaccaagagtgcgatatctctgggtgacgagatggcctcgttcaacataaacaaattctcccaagtaagttttattacgagtttacacgcgtcctcgtacttgatacgaaacatgtacgcgaccatgtgatgcttgtaggcgttgatcgtcattgcatatttaaagtagctaaactgcttcgtgatcgtgtttggtatcaagtattgtacatttttgtattggacatcgattactggcttttcatagagaatcgacgattccatgcatatgggtttgttgtaaatttcagggtcacttggaatcctgctagtttcgatgcataggaaaatgtccatttttcaacactgttttaatctcacttttgatgtaacgatttaacctataaatattgtttcaggaatttgaacagtttattgagagtaagatttttgccagtatgattcaaaaactgactagaacggctcgcatcattacactcaaactgcgacgtaaacgagtcactcccgaggttgaaaaagagtccaagattacgcagcgcaacaatcagtatcaaattatggctcggaatattatttactttctcatctatcagaccacgtacggtactcatcccaaggtggtgattgcatccaaacgcactcactactatggagccaattccgagtacgataccgacatgattatgaacctggacaagtacatgaagcatttcatctctttggtgtacgaaaagtttgccgagcaactgcgcaaatcgtacactgacaaggacaagagtaaggctgagcaacaacaacaacagcaacaacaggctcaggctgagattcagggtcaggttgaaactgatcagattatacaagctcagcctgcgtatatacaaaatcacaagcaagacagtgacgatgaggacgacgatgaggacgacgaagacggctacaattcggatgcgagttgcatcaacgattacgatgcctattctagagtgtgcaatcatgtaaagaaactgttggacaatggagttggaaatgccaatagttgtgtaagtgccagtaacggtaacattgaagattccgagtctcgagatgggtgtatggatgaggatggggaggatagggttgatggggattcggatgaggatatttccaacgtacccaaagagtttaacatacctaaagagtccaaagagcccaaagatgcctctaaagattccaccaaagagtactctaatgacaatgacgattccaattctgttgtaaatgatcacattagtgttggtgctagtgctagtaccagtaccagtgccagtgccagcatcgttgctagcaatggagatgctgaaagtgtatacagcaccggtgggactcgttaccttacaaccgactctaacaaacgtttaaagctaaactctagcatcgaagacgatgacgatgacgaggagttggccggcaactatagtgtgtccggatccgtgtctacactgaaacccatcaatctggccatgtactcggaggccaagtccaagtacaatgagactatacagaatgacaacattatcaaaaagctctacctcagcctcttgatggaattgaatcaatccaaactgttgtcgttcctcttggaaaagattgaaaacaaacgctatgcacagcgggcagtgatggaggttttgcgcgagtctagccgcaaactgtcacgcaaaggagtcgcattcgcacagcgcatccagtacttggactatattgaaaacttgctaaagcaacagtgctacaaggacgtggccgataaattgcacactctggcactcgatctcgagtacaattgtttccggtacacggacgtggtgaatcccaacgacgattgtctgcccatagatttgaagcactttgacactctggccagattcaccaaaaccgtgtacggctacagtactcatacgccgctgaatttgaccaccgagagtcacactctggacggtaagatttacgacattgtaaagtttacccgagacggtgagagtgagattttcgatgtgcgtgcagtgaatcaagtgcagttggacttcaagtcttggaaggatcgtctaaactgtctacccacggatcagttgccgcagagctacataaagattataccgcacaaaatcaacaagattaacatttggtcgggcaagctcaaagaggaggctgacaagacgtacttgtatgtgcgcaccagtggcctgggcagaggcactctgtttatgaacattggtaagagtgccgagaagcgtagaaacaagacattcccggtgctcaacactcgtcacaagaaactgaaaaaggaccacttgtacgatggcgatgtggtagagaccaagatcaacaaggatgccgaaaagattataatggcaccgatggagaactgcaagattgcatccaccgttaaatcggacattgcgtttgacgtgtctcgtttgatgggctcggtgatgactgcggacagtagcatttacagtgaacgaggggaggacgaggaggatgccgagtgagttgttgttttagtattattagtattgattggtattgattagtattagtgttggtattagtattagtgttggttagagtgctagtattaattaagagtaaaagtgttggtgttggtattagtgttagagtcccatgtgtgtgtgctaggttataagatttcaactcttgtttgcattacttgtttgtattactataagatgcctcttttgttcatgtttagttgtaacgactcttttaattacttgtaattgtactgtggttttttagaatagattttacaaatcaaggaaaattgtatacaggatgtggtactaggcactagtatacattgtgtaatgactataattaacaaatggttttatcaacacgccctttggtgtcacatcctgtgtcggtatatataaaccaaaacatttgacgatagtcttcagttgacctacaaaccttgacaagtgtacatctcctgggctgtgctactcctgggctgtgctatatttgatctgtactatacttggactgtactataatgggcgcctgttttgaatagagtgcaagcatcgtgcagctcgacccgttgctctgagaatttagttgctcacaagttgtgttgcagctacaatttcagtaggcgcttggactctagttttttagaatacaaaccattcaaagagcacatgttgctctttcaaatatagacttttattattatcattccatcatattgtacctactttactactttgaattacctctgtgcctaggtaacaatatttctgtcatggtcacttcatttccatttgtgttgtactagtttcagttatgagtttgatttagtttttgatttaattttgaatttaaagtgtataatttaaagtttgcattgactatatagttggagtttagttttatacaaatcaagcatcgtaacacaaaccaccatgacgtacaaccctcaaataccgagccaggaaaagtgctgctaccgagtgctgaccagactgagaccgattcagactacggtattggacaagttgccgactgcgagtgctgcacgctttgagagtgcatccaaaggaggcgccgaatctttccacagtgtagagtttgaaaacaccgtcgttgcggatcccaacagtggtgccgacgatgaagcaatgatgcttagtctgcccacgttcgaagagagcatccaactaaacgaatcggtaaaggatgtcctagaggagcacaagtcaaagtgttcagatttgtacgcgctcaacatggtcaaggttagaaaatgcaccaagaccactcgtgcccgcatcgcatcgtacaagtggcgtcggtacaagattgatgcagtgcagtgtcctacgttttcatggtagcttgtgtgatgattgattgatgaatatatatctcgtgactaaagtctctttgatttgtatacgatttagtattagtattagtattagatacgtaactagtatttaagagcaacctagttgtttaactgccttgcaccttcctactaaatgtaacactttgaaatgctgtaaattttctagttttagtattagtactatagtagtaaatagtatagtagtaataataatatagtagtataatataatagtagtaaaatcaaatactaaaacacacacaactactagtacctaataaactgaacaataaaaaccaagattcaaatacaaagttgttttcattcctgagagtattcaaatgtagaatcttaaaaatccgagagagtaacctaaattcagaatctttaacttgaatgcagtggatattcaaatgtgtatatacttttggattttaacaaagacttgaactgagatttcatacagagattttagaggttagagttggagtttaaagtttagataacaggtagagatttacatgtatttaaatgtacctaccaagtttttgtattttttagactaattcaactcgtaactaattcaactcgtaactaattcaactctataaatcaccaccgagtccgtaccgttagcctccaacatctagttttaccacaattctcaaaatgtcattacataaacatgatcccataaacatgaacccatcagccgagcagtagctagtcaataaattaaaccagacacccagtaaattaagcttttgatcgatacctgccaatgtagatgcataatgaaattgtaattcagtccatgtaaagcaatccaatggattcccagagtctgtattttacaagtcaaatgttgttttccgctaatgaaactgagactttgattttgatttaattatggatgcatccctataaaggaaagagtaggaggatgggtaggaggatgggtaggaagattacaggaggtagagttaaactaaaaaaatataaatcacaacagtttgagtattaaaatctttatttgtacaaactaagtacaaccattacctatattgaatactaaaactacatagaactagaattagaactagcactaaaactagtcaatactttaatctaaaacacattataaagcaccattaatctcaacaacaagtaaccgcaccacctccacctcaaaacacgtataaatcatcaatcctatcaaacaagtcaccgcaacactctacacaatagagattcgacaagttgaacaacgacgacaacggattcggatagcgatactggatatcgcatcgcttacagtagcccgtgtacgagactccttcgacgcccggacacaggtagtagtcgggcggcagagttcgatgaaagagtttggcctttaaatgcttcggaatatggtaggcgcaaatcttttccctcaacgagtccacataatccaagggcgagttggcatcgctcatcgacaccctggcatggtgtacatcgctcaatgcatccaaaatgatcgactccaaagacttggcattgaagcgtttcttgaatatttttgcaatgatcgactttagattctttctgatcggcatgatgaaaaatgtgcataaaccaataaactagcgtcaaagataagcacaatagcgtattgcctttgcagaattcgctatattaatgatggtagcgttgcaagtgtagtgccttttaaatgcaatttcttatcagtgtttgtatataaaagcttagtgacgccgttttgtggtttagtagtcacgatgatgtacgctgacgaggaacactattacaacaacaagatttcggacgagtctataaaatggaccgaccgagtctacgtcctcgattgggcatcgaccaagaatcagatttacgcgttcggtgtagacgagtccggggactcggcaaagctaatgatcaacaacgtcaagacctcgctctttgtgtttgccgagaacgagatgcatctgacgccgttgctcaatctcagacacgttgacctggagcggcccatacgcgagctctcctcgttcaactttgagattcccaacaatactctgctcgatacgttgattcaaacgactagtgttcagtacaagacgtttcaagtgcccacctgtagctttggcgattctcaaaatctacacaaactcttgaacacgaccgctctgaagaatcacatcaagactacggccacttggtccctggagttgttgattgtctttgaaatggcgtgccgtacgagtcaggccagtctggaagagtgctcggtgtacgatgtgtttgtcgacgccaatctggctcgctacgaagacttgcccaagccaaagattgacattgtggcctttgatatcgagactctgtctagctttgattaccgactacccctgggagactataagaatgacattttgttttcagcctcgataaaggatcacggcaccaacacaatgtacagttttgtcaatataccggtgccggtggattttgattacaccactactggtagtggcactgtggccaaacgtgcacgattggaacaaaccgatacggtggatgccaactcggaatcggtacgagcctatacggaacgcctaaagagtttgatggagcgagactttgaagccactcgcaacatgcaacgcaaactggtggtcgtgcacgatgaggtggatctcattcggctcatcctacagacgctggatcgcaagaggctctattttctgttgggctacaatagcaagggttacgatatgacttttctcattaaacgcaccgcctacctgtgtctgcccgagtttaaaaactttaccctgtaccgaggcatgccagtgtacggaaatcacatgattcacattgatttgattaaaatctttcgtcaactctatccggaggtgggtaagctgtcgctggacactatggccaaactgtgtctgggacaggccgagggtaaggtggagtttaacgccatcaacattcgacacgtgtaccgacaactcttggaacgaggcctgcccaatgacgagtgccactttgaaaagtttaacattgacctggccaccattgtgcactacaacgatgtcgataccgagctactgtgtcgactgtgggactcgctcagctacgacgagtttctacccaagctgtgcaagagccatttgatttccattgtacggtacacgcagtgcaagattggagagtttatcaacaacaagtctgtctacagtagtttgaccgatggtaagattttgacactgcacaagagcatcggtggtgggctaatgatcaccaccaacggtagcgtcatgtacacgtacaatcagaatcaagtgtcggcgggagtgaacgaggccagctacggtggaggattcaatatgcgcatcgcccgagaagtgtttaccaattgtaaagtgaacgatgtggtcgcctattatcccaaattgaaacagggtcacaacatttcatatgaaacgatcgcaatcgttccggtgcacgtactgcagcgactcagacccattctgaatccaaaccatccgtgcagatatttcacatttaccgtgcacaagtgttccaaggaagaggtcgtaaatcatgcaaacactcgtaacctgatcaatatgctggagaataattgcgatgaatttagttcattggacgagtgttgtaaaaacttgaattccaacgatcgtgtgctaatattgagcgttgagcgaaaaccgtctctattgggcaacatgattcacaaacaaaacgttttacgatctcgagccaaggatttgaaaaaggaaatggagaccatgttgacccaggtgcagatacgattggatgcggtaaagaatagaggcgacgactatcaagaggttgtgtttgattttgatgacgatgatgacgatgaggaggaggaggacgaggatgaggacgaggatgagaacaaagatgaggataaagaggacgacaaagactctgatactaaaactgaggataaatctaaaactgaaaccaacactgaatctaaatcaaacactgaatccaatactgaatctaaaaccgactctaacactgacgacccctccaaacctgagaatatggaactttgcgatactggctctatattcaacactgccgatgtggacaaaagtagtgatatgaaaatgctagtgcccaagtttaaactgctaacctttgacgaaatcaaccgatgcaacgatgttcaattgttgaccgactatgaggttaaactcaagggtgaactgtctcgaatcaactcgttgtatcgcaacttgaagattgtcaactgtagctactacggcctcttgggttccgactatggagcgctcagcggtagactggtggcggcagcgctcaccactctgggtcgcaagtacattatagacatggccaggtttgctcatgtgcaaaactttaaggcagtactgatcgataccgattcggtgtttgtacacaatggtgactcgaatctggaaaacaatccactgcccgagttttgcaagactctgaatgaggaactcgaactgaccgccaagatgtatcagttcatctttataatggccaaaaaggtctatctggccaagtgcaagggtgaatggatatcgagaggtataaacaagaacggtcccaccatttggaacgatgtcatctttacactggccgagcgctacctgattgagcgcgtaccgatatcctcaaagatgctacaagacattctagtcaacgaggtgtacatgtacattgcagagcgtgcacgcaaagatcgcagcgtagtactgtgcatgatgagcacgaatcgtgaaaaggtggacactgccaacacgcccattgcaaagatgatgcgagccgttgtggaggacgagcccgattacatattcggagagaagcaagtcaaatactttcattacttgaaaaacaaaccgaccgatgtaatctttgaggctgcccatcacttgaacgatgtgcacatttcacagttgaatctgtacaagtttgtgtccaagattaacactaccatctatcagatcctctcaaaggccatctacgatgccaacgtcaaggagcgaggagtgcacgcaaccatcacgatggccgagtacaacatagactcgatggctgcctttttgcgtgtaaatgaaattatgaagggatgggaggattgaggtagtctttgctggggatttagttttatatgagatttgtataaatattaatgttggagtgtttagattttaaataaatgtacctatctaaattgtagttaaataaatatatactaaccaagtaatactttgttctttttttaaacacatctacttcctcagcttttgctccaaaaggctaccggctgctacctaatatctaccattctacccacatcaccagactcattacaggtccaatgactcgtcatttgttcaacgcacggaacgtgtgtttacacttgacctttcaatctcaactttgttgcaacagtacacagcactgtacaatacagtgtgtgcgcgtgctcagatcaacttttcttattcataatacaaacttacaatgctaattaatgttgttgtaaattgttgaattggtcataaaatgctaataaattacacgcctataaataaagtaggtaacggtcgggtaatttacattatacggaaatcgtaaatgttatggtgcccggggaaaggtgtaagcttatctaaacccatcaacggccacttttgttggacattatagtttctggatatttgttatatgggcactttgggtagacttgcaagtaaggttgtttgggtctttgaaatgaaacgtgttggtatactacacacaacatttattcaagcaagtagcaagtaatctaggattggatgggtttacaataagggtactcgtttggaggttataagttaatatacaagtgattggcttgtttagaacctgatataccgtgctctacctctctctctacctctatcaacaaaaacatgtagaatgacgagttggagtttgtgtacttacagttgcttacttacttacttaggcacttacttatttacttacttacttacttacttactctacaagtataggttagcaaataaacattacatcacaagccgtctttatagctttgccaactgcaagtgttacaactatataaaactgtcacaactaatattacaactatcaaaaaacataatctaccaaacttatcaccaacaggtttaattttattccaatacttttaattttattccagtactttgattttattacaatacttttaagtttattctagtacttttaaatgtattccattacttttaattttattccagtacacttaatcctacatagtaacaccaaatccaattcaaagaacagtcaaaacaatcgtgcaaagcaaagctcaagtcagagagacttgtactactcttactatgaaacaacaatacagtgcaacaatgctaaaataataacgctactactacactagtcagtaaaatgtgaacaaacaggacactggtaaatacatgtacacacaacaatgcatccggtacaactttgcaaaagtatctctcagtacaactcttcccttagactatatgctaatgctaattttatatcctatattttacattttagaaaacacctctaatagatttctctctcgctgacattatgttttaattaaaactctgatcacgcacgcaatgcacattaacctaataaacgtaaccgattcccagcacgtgtaccacaactgtatgttttgatatttatttatgacttggtagtctaaaaaattaaatcaaattgttagtctaaaaaattaaatcaaactgttagtctaaaaaacaagaattattagtattctaaaaaacaagaattattagtattctaaaaaacaagaattgtcagtattctaaaaaataaaaagtatcattattctaaaaaactaaaacacacgcacacacaatcctttaacatttcgaccctaattcaatgcaaagttgcaagacaaaaggtatcagtggtttttgtcaaacacacagcatactacaaagtaagattcaaatagcaagtcaaagtttgaataggtagcagtggttgtaatagtttacgattcctttattctaggttacttaactcaactactttactacatactttagcgcctactctactatatgctttgcaccctactttacctcctacttacctcctactttactccctacttacatctactttaccaaaaaactaaaactaatctaaagactacattcattcattactattctctaaacttatagctagatgcatttattagtaaatctattgaatacatctattgaatacatacatttattgaatccatacatctactgctacatacatctatcgatgcctacatttattgaatacacacatctattgatacatcatcaacatcatctaaaactctaccaccaacacatttactttttagaacgcttatcggccggctcagactccgcctcttcctcttcagcatggtcaacttcctcaacgtccgccttcttggaagctgtgctatttttgtccttctcctcgctagaatgggaacgcttctttggcaacgtagtgctcataatggaaccgccgccaccttggtggtccatcttgtccaataaatcttccaacattttaatgtagtgtgtaaactcttcaatgttgtcgttaaagtgcaccaagtgcagcttttcaatcaacatcgtaatcaaactggacaggttgctcttggacagtctggctgccactatgcgcatcctgaccggcagattggacactacaacgtgctcgctgtcatcgcaaatcaaccggtgcatctgcagcttgtacatttccattttgccagatgtcttgtgattgaacgatgccacactgggagtcttgaagtatttaatgttggcaaacttttcatcgtgatcggccatcatccaagtgtagccgttagactctttgacggtgggcgcgtgcttcagtacggaatcgtccaatatgcaatagccaaagatgaggttcttggcatcggcaaccaggtgcacctgcttgacagtgacctttgtcagaatgttgcgcagcacctcattggctttggccgtcttgatgagcacactcttgcaactggccgaaatcttggtgggatcagagccgggttccagttcgagttcattggcaacgctacgccatctggcaacatcggtggtgtactgtcgctgaatcaagtctgcgcagccgacaatcttgtacactttgggaggcgttacatacttgtagtccatgttgtactttagtgagactagctcttttacgatcaaacaatcgcacgggccattgtacatttccagtttgttgctgcttgtcggcagcgatttaaaagtaatctgcatgggcggcttgctcacaaacagacttgcaatcttggccaagcgatcggtgtacgtaaacatttcaatatccagaccgttgaccgatagtaaatctacaatgtgcaactgctggccattgtacacgacaacgtcaaaagtgtacactcccggtattacggcatcgataactttaacgtactcgtcaaaacaggccggagaccaatgaaggggctttagatcttctacaagctcaccgggtatgcgttcgtaaaacgacaaagtcttgttgaacgagtcgagtttcaagattgtctgaaaatctccactctcatagtacatgtaatcggtgagctcctggtgggtgatggacttggttttcggtacgcggttcatggtgtcgagttaaattatcgtcaaatgcaaaaggttaaagagtatgctcacacgcaaagtatgagaatgctcgcaacgcaatgcttcagaactacataaatgtgaaccgtttataacaccaataggctatacgcgttacggtcgataagctgtatataaatattaaaagtaaattttcataatttctgcagtcggccctctacacatggggcacttgtccaactgtttggtcacgcaccagccgcacgaaacgagatgcttgcacggtaatatcacaatatctgcacgatgcgaacagcacagcaggcactcaccctgacgatccgcagtgtcttgaacgaccgcagtcttgataaagaaccgcgcaaagttggcctttgactgagtcttgtgcataaacgtagagttttttgtaatgttgtacacaaagtctacaccctttattcgcaataggaagcgacaatttttggaacacttggcgtgctgaatccacggatcgtcctccggtagccatttcgagattcgtacaccgcacaagtaacattgcacttcgtcgcacatgttgctgtaaaaaaatccagcctctgccaacgagactggacactgttgcagaccgacgggccatctcgagaaactcttcaatctcgttgtaatattgcggtacagcaacagggattgcgtcaagtcaacatgagcggaggcggtcgacattttaccgatactgtggcccacagtgtttgttattgtgtgtagtatgcagaaccactagtgttagaggttttgtacgcgccttgtttacaccctttgaaaaaaagagtacccaagtgactgaggggttattagcttttatagcaggcttgtaaatgtgaggtgtgtgttgtagtgtacctttttatatttacatgtatttatatgaatttatatgcagttatatatttgtatatatttgtatgcagttgtatgtatttgtatgaagttgtatgtatttatatacatttataaatatgtgtagtgtcagtagatggattgtgtttacaataaaagtacattttgagtttaaatctaaccacactgtttaatggctaattctaaatctattttatactctttaaatctaataacaactctttctaaatctaatatcaactctatttctaaatctaacaccaactctttctaaatctaataccaactctatttctaaatctacttgtgtattactaaatgtaaaccatttaaacatgtacttccaactgtatttctaactgtagttctaaatatagtttaattctaaattcaaactgaacctattctaagacactaatctaaaattaacaaccaccacagaatgagcataaaagtagtactatgaaaagtagtatgaaaagtagtctgaatagtagtatgaaaggtagtatgaaaagtagtctgaaaaggatcagtatgtagagacaagttacaatagtgtgaaaatgatcaagatgaaattaaaagtagttttaattgaatcattctagttttttgatctacaattgtgtgcattaaaaacattatttcatttaaactgtgtttagatatcccgttgttttgaacttgtaacaattacaccgacgtcaacttcaaactccaaccttggttacaccaccaccaccgatgcgtccgtttgctgatgttgatccatcttctgaatctccgtgttggtggacgcgtcaactgtaagaaactttggggatgagtaccggggaggcggcttataacaaggtggaggagtgcgttcaaacgaattggaaatggaaaggagtgcggtgcgttcgatagacttgtttatagaattgctaataacgccatttagtgaatctatgcgattgtaaaagcaatacgaagacgatgaagatgaggccgagtccagtgaagagtttgatggcatgtaattattaccaccggtcaacgtttgtgtggaccgatccatcagacgacaatggtcctcgtccgtctgcgtgatgccgacattggtctcgacactagtctggcagccaatggtgttgctagtcttgatttcagagtagtctggagcctgatcatagtattctggctccgagtaggtttccgactcgttgcaagattcataataggaagtgttgatstyscrstcgacatkgmsksytggkgmaytcgatkttgttgaatgccagactttggttatactgattaaagggagcattctggttaaatgactgaatctgattaaactgattgtgcatctgatccagtgcctggttctggctgctatagttttgtggtttgtaatactgatgaaaatgcataaaattgtcaatgtttgtatacttgctagtgttgttggtgttggtgttgctatggttattgattcctgtattattgtttgcaataaaattgttggtactgytttgagtattgtacttgttggcctttctggacacatcctcagacttgatgacaatctgtatagtttyaaactctggccgtggttcastgtccgaggtgcagtcttcgtccacgtacacgctacactntaktgggccactattgttgatgtaaatcactttaccgcaatcgtccctgtagtagggttcgtcsbcaatgtartmacttgcatcctcatycctctttcrkcctthsgatgcagctacaaagggyctattgttccaagwttcastgtgcaaccgttatagtsctgggatgatctgtcgattgatgctgavggtwgaagactgnakggttgaatttkaggawgkwtcstttvattgrasgctgrgaaygcsactcavhtbgaggwyttgatgcadgaagstgatggaacgcgttngtadgwatttgwatgkgttccwtccdttmtaggatgttadwttcktgatctgtaagggatwchattawthggggatattmagaawykcctawtvtgatactkgtgtnnccarstggaagrttaaatacwttcycaaattgaaancntttcccaaaanactcttnaccctgaaggttgtntncctcgtcacccngncgtnagcgncannaagtgtnngtnagttcancgnnntcataaanagnatattttaaannaaannannnngaannagnacgancngnantnanngctnccaattgangaggcganncgtgcggantaatancntcantgntcacanggngntcgngttcngagntaaggangngtantctngtnaatannnngcaaggagtnncnagnggngcncangnagtananaagnganncggcncgnngtatacnnattangnccattntnntcanganngacnaataanctngnccancctnngctnangtncggcttnagccgaggnatagcnctacncggnnctcnnngtacnannnttcnantcncagncnncanngnanntggngngntnaacngnaccangaantgcnnantgnctnacagtaaatnnnatntacggtganttataanngacaggtaggatnaagngtnnaccantataagatcanntctagcangtacnnagccacgaanggtgccnnatctccccnctaaatgtntnnatcnncacatnaactatcnttnttatcantnaactgntatttgactataaatagccggcatgagctattggatntnatngtcnaaccagttgnantcaagagtntagcatgttagacatggccctattnnaaactaactgtnancacnnttnggcaaaaaatcatggttctactgaaccattaaactgaggmattcgawatgtgtaaagacaagsatttgtagatggatttgtagaaggktacatttagakttcaacttgatatacatataggtacactgattttataaacatctttttactatacacatagagatgtatattgtaggagtttgacatttatattaacatttacatttaaacattgctctaaaaacaaatgcacgcacacacatatttatcaaccaagtacctgctaagagcagatcacactaatcataccgtgtaaataatcaccctctgaatcaggtcaactatccttgcggctactattattgtaatagcatttacaattggtataaattaacgacggtctggctcggttatagtttgaacattttgaagggtccaacactaaagtggaaacattagcagcagcaacagtagtggctgcaatattgttctacaattgaaattacaagtttacttgcaagttttggtaatgcacaaagggacgtttacaactcaccaatggtctcgtctacgtagattatccgaggccgattgcgtacattgcagcgctccggtgtcggtggtcttgcacgacgtccaatgtcagagttttccaatcgttgaatcatacgcttgagcgataaattggagtttatcgaaatgttggtattggtcgatgcatctgtggaggatagagggagagagtgttttatatggtacttttgttaagaggttaattttattggttatttgtacatgcatgtataaacaatgtgtattaaggaagcgtgcattgacaatgtgtaattcaggaaacgagtgtctgtcaatagaaaatgtacaaaacagttaccgctagtgttgattgtttcaatcctgctggcatctatattgacgtctgtagagttgtagtcctctgtgttgtactctgtagtttcgtctgtgttttcatctgtatcttcatttgtgttttcatcagtattttcatcagtatgttcatctgtatcgtcagttgtgttttcctcagtattttcatttgtattctcatctgtattatattctgtattatcttcagtagtctcgcctacattagtagcatcttcattggtggcatattctgcatccacatctacatctacctctgcattacttgattcggcatccacatttacatctacattacttgattccacattacgtgatcccacattatttgactccacattacttgactccactccagcattgccagatcctgtattggaattgctcacctctgatacctccgagtctacatctataatacttgtctcgataacgttgctggtatcaataatgccaccatcaacagtactcccatcaatagtgctcccatcaacagtgctaccatcaacagttctaccattaaccacaacaacactagactcctccacaacaccatccttgttggaattatccatagtgttagccttctcaatagcactagcacctctacctctctccatattgtcaacatctacattgggagtcgcatctgtagattcaaaactttcaacaatactcctcttgactcggtgcagtttgcatctgcgcatagtactgttgtagtcatttttagaaatgtattcattcttgttgtactcattcttgttgtactcattcttgttgtactcatttttgttgtactcattcttgttgtattcatttttagaaatggcccggtactctatgaaagagcctttgtgtacacttttagaagcatccataaattgctcatcctccgagtcttgtatgaccacgggcgttgcgctaatcgttgcccgattgctgtacacgttgctactgtcctctgagcaatctgaagagacgctagtgtttatgctgccgtatcggacattcttcaagtctacaatattgccggcagcaatagtatcagcaggattgcaatcagtgtactcaaatgaaccaagtacaggttcggcatccgtgctgcaagattgtccacgtcgtacattctctccagtgccagctttgtcaaattggcaatcattgcactctgaggagtctgcaccacaaccaccaccttgaatggacatggaatgggatgtttaaatatttacaaaggttagtgtgtattatgcagaggtggaatgtaacagtacagagagagcgagcgagtatagtttagattaaatgtgacttttagatttttttatatgtatgcctgaattaaataaatgatgcagatgaaatggtttacgacactctaaatttattgcaaactcaagttataggcaaactaaatttataaccaaactcaatttataaacaaattcaatttatagataaaatcaatttatagacaaaattaatttaatttatctacacttgaaggatgcacactcaagggatcgtttattctactttttgcagcaatttaattaccgtccagtgagagtataaatataagagagtgtaaatttagtcgatacatgtgcacaagtacaggtgttcatttataaatgttaaaaacaacactaaatattaaaacaacaataatagtaacaacaaccaacacaactcacccagaatcctcttctttatcgactctacgtagagtgggccctttttgtacagtaaaaacacgcatcggtcaaagtgtatggcatgctgttcccagggatcatcgcacgggttccaatcgtttagtccgccgtcgcaatagaaacactttgtacaatcgaccatgccagcataaaagaatcccgcctcggccaacgctatcggagtgggcctcttgaacacgctccagttgccgataaacgaatcgagtctcgacttgaaataccgatactggggattagcgtacatgggcagatttgcgtacgcatactcgcaagttggtgacaaacgaatgtgtatcaattgaggtttgtttacaaactcttggtactctttgctgttccacaagaggatgcacttgcaaaaggtacactttaatatatttgctccacagaaatagaaaccagttttggccaatttcatacccagaatcatcgagtccttccagttggagctcgtaaaagtttcgattctctcaatttcattcatctcgctgatgtgcacaaaacactgtttttaaattaaatttagtacgcaaacgtagcctcaataggttattgcttttatgatatttaacgtttatatggctatttaaaaatgacaccgacctacactaaaagtataataataactacaccgaaccaacagtccatttaacactgctgacagacgacgactagtggtgttattgagaagtcgtgagaaataatcacctccccaccaaacctctacaactatactacactactactgtagcttggctgataataataatatttaatatcaatttgcaaccgagcccattgctagacaagtttacaccacattgactacagtgtaacttaatttatagcataaatgtgtagtatctactactacatctatacgtttattgatattattcattctgtagagtttacaatttctaatcagaggttgtaaaactgtaatgtggttattattgttaataataataatcataatacagattagttaatggtagagtgccgttgataatttattatccggtttttatttaattttataatttaacttatctcggtctctagatacaacatttatttacagcttgctttttattgtttccctttttatagcatcatttccgggcaaaactatatagagagttggagcctttctctctcctagaaaagatatctaattttatagaggatctaaattatactgttatttaagattatttacatcaagattatttataatgagcaacgtaaaggcgtcccatttaaagctcttgaacgatctaaagattaacattgaaacgctcaaagattccaacataaagagcgtctttgagcaaattacaaaggagcgtcccaaacttacggacaactacaagattagcatattgaccacgatcaagtctctcaatccccgagtcactctgacctatcccaagattggactgttgcaacaaaagagcggaactctgaccggtagcgtgattaaaaactttaccatcacccttgtgcgattgattcaagagtttaaaacgtttacagtcaacgacatgggcatggtcaatttgcgcacaatcgataccgtcatcgcttcgtgcctccatctgtgcacccgtgtaccgatcgcacacctggaatcgttaaagtacacgcacctaatcaatcagacaccgtacacggccaatcgccggcaatatgtgctcagacgagtcgagccgctctacacgatcctattgccggtgatcaaacatgcactcttgatcaaacgacactttacgtttcaagtgaacccattggccatggacgaggactcgatagactttataccactagactataaaatggtgacggttaggcacgatgcaatcaacaagactcttagggaatcgtacatgcgttacattatggacacaccgaccacatcgttgggcttgatcaagctaaagattgtcaatcggaatctattgttgacaatgctgcgcgatgaagactatggattcacagaggatgtaggaggaggaggaggaggaggaggattaggagatggagacagtgatgacgataaaggaaacaatgcaccatccaatacaaacaatgcatcgttcaatctattgaattttgaaagtggtagcaacaactacaacaactacaacaacaaccaggataccaatacagagtttgatacaaatttaaagcttccaaaaaatgaaaagcctagaaaaccaatggatcccggagacttgctgagactggcactgctcgatgccggtatagattttagtaaaatgacacctgcatcggagagtaccggcactggtaccggtgctgtcactggagccaatatgagcaatactgggactgttggcatcaatggtaatgtcggactctctggcggcattgataatgagactatacaaaacttgaaagatgagatgatgcgaggagtcagagagtctcgatatacagataccgatacaaaaacaggtataaatacaggtataggtacagatgcaaatacagtaccctcaagtatacttgaccctacactaagagtagccaagcttgagcccattactactccaacatctagacccattcctaacttggcagctataaatactctaaagtctactactactgctactaaacctatcactaaatccactaatgaacctactactcttaaacctactaaaccacctaccatcaaacctattcctaaaccacccactaccaaacctattcctactccaacacagaaacctacaatatcagtaaaatccacaactctactaaaacatcctccgatgcaacaaatgcctcaatcatccaagcaacaaatgcctcaatctcccgaaaccacccgtaaacgtccgagtacaccatttgtggtgcctcctcagatagaagattacgacgacgacgatgaagatgtggacgaagaggacggatacatttacgacgactatgcagagtttgccgacgactctaatctaactttggatttcgaaaacgattcgaacatattgaacgtgcaaagcaacgattacaacaatactcggcagagcgataacaccaatacgataaacgaacaaagttacaagccgtttattaaagaatctgctatcggtggtgcaaacaatgcagccagtattaacagtgtgaataatgtgtcatacaatgtagcaaacaatggaactgcagaaagattcaaaggcagacgacctgtgcaccgagagagcgtacaggataccttatccatgttcacagagggctaccaagatgacgatttgaacgcggacaaggaggtttcgaaaactgatgccatcatcgatgcgatcaatcgcagccgaatccatcatctgaaaccggatcgaccgttgattgatcgcaaacgaccgctaccgccaagggtggaggttttgaatacttcggcattcggaccgcagccgtatcctctactggcgccgtaccgagtgcccagcaatctgggaatcgtagactcggacgattacgagtacgatgcgagtacgattcgcgatcctgactacgaggcgtacatggccaaacgtagtcggatcgatagcgcagatgttatgaacaaggttgagcggttaaatctaatggaaagattaaatagagccagtactagtactggtggtaattctttaaattgatttgtgtgtatttcaagttaaacgtaggcacctatcaaagtatcaaagtatttagtatttgttgtagtacctaattgatttgttacacttgtattgttaattgttaaaaatatagttttagaataatgttgactttgttttttagaatttaccatccttcttatccgttagaaataaacacaatggttacactcatagagattggccgattcctcaacggctatgctaaaaactcggaacagctaactctgtggctgaccagcatggatgccgaatccatgtactgttgcatacgattgtttatagacaaaaagtggcgtcgtcaactcatcgcaacgtggaggactgccaaaaaggttgtcatcaatatgcacgacaagtgtgcatgtttgaatcgttggggcaacctgatatccaaacagattctccaacagattggcaagtgtgactatgagtcgttcgaagacgacgacgcaaccagactgatttgcaaactactagtggatcaggacgagggctttgtctactatagcgataaagtgtttcgaagcggttgtagtaaaattgaatttatagacactgtaaaattggagccttgcaataaacgccgtagtcaacagtgtgcgtcatttgaacgtctagacgtaaactatcaagagtgcggccaagatgccagtaattattattgtcctaaaaaacaaaccaacgacgacagactgaccattgtacaattgttcaagacaccgcatcatttaatcttgaaacaatgcacaccgctagaggcctacattatatcgtcgatgagtctcaatgtgaccgtcaacgatctgactcgcagtctgcccgaatactaccgattcggcatacgcaacgacatcaaggatcaacccatagtgtttgatctttttcacggcatgtacaactttcacgtggcacgtagtgtctttacgtgcgacaccaatctgatggcctactacaaactgccgagcgtatcttacgagacagaggccacgctcaacgtttccgatctggacgccatgtgcagcgactattgcgtacagcccagcttcaagggagtccacctgtgtctgtgcctaacggaagactgcaagtactacatgctaaacaggcacggtgtacgggtgcgaatcaacaatcgagccatcctacgagcactgccctcggtcaagggtctgtcgtacttttgcggagagtttatgctcatgggctacggtacgtccgatgtagagtgctgtctgcgatcgtactcttcgagttcgcgatgcatcaacggcaacgatgaagcctactgttttgtactgttggatctctatctggtcaatggtaaatccatactggacaatacgtacgaggaacgcttggatgtggccagacgtgtatttgccgattgctacacttcggatgagccctttgggggagatattttcaaggaagatgatgaggttgatgtagattctaatagttctagtagtgctagcatttctaacaattctagcagttctaataattctaacaattctaacaattcaacatgtacaactgagaataaagacaaggaccattcatcaacattaaccacagacggcacagaatacattgaaattgatccaggagaagacttgcaattacacttggattctataaaactaaaatctgaagcagaacgtaaaacaaggtccagatcatctgaatgtgaatctggtgcatatggcaccgataccgactctggttctggtactgatactgactctgaatctgaacctgaacctgaacctggcactgacaccgactctgaatcctcatcactgaaacctaaagtaaaagtaaaggctagacgtacgcaagacacgctaatgaaaaagattaggcgttccatacgcaaccaaaaggtcaaaggagccggtcgattgtttatcgtagaaaactttaaggacagctctgaattgatcgagtttcagagcaaatgcgacaagtttgacttttacgccaacggtataatcatacggaagcgagcgtcggaaaacatgtgcaccaagattatcaagattccatttgagcgtcaacactggcgtctcgtagactcgcagggattcgaatgcgaagtgaccctgtccaagtatgacaatccgaccatgtgcgtagacgacctgtttccgtctcgactgtgggcaatcgaacagcaatcttgcgtccggtgcaagtttaacgcagtgtgttacggaacatcaggcgtcgacggcaacaatgaacgcatacgcatgcactttgctataaacaatggacaaggcgtttacgttcactttttcagtgtgcagtgcatctttagattttccacactgtgctacgacctggaccgagtggctaccgtgaaatcgtctcgcatcctcgtagacgacgaaccccacgaatggttcgtgtgccggctgggttttgccgaagcggaaccgcccttcaagacgctaaactcgctgagtgtacgctttgatctgtcgctgtcggattgtgtgaatttggcacatttccgtaacatgtaaagtgttgctattgtggtgcatagtgccaataccgtattggtgttgtatgcacccagtgtctagtttagagagtgccctattcacaatgactcttgaaacttgtcaaattgacgaaagctgcgaggtgcgcaggcccagaggtagatctcgctcacggtcacgatccaggtcgcgttctcgctctcgttcgggaaaccgtagcactgcccgatctggcagaggccgcagccgcagcaggagccgttctcgctcacgcagccgcagcaggggctccaggaggggaactcagatgtaaagagtgtagtgatttggtcaagtatagtttaatgcaatggtaaaaagtgtactggtaaaacgtatactggtaaaaagtatatttgtaaaaaaatatactggtaaaaagtacaactatacttgcagctgatttaatgttagagtatgtgtatgagtatgagtacgagtatgagtatgagccacactgatacacttatatagtgtacaaaagtaaacctcaagtctcggggtatagtgtataaaaataaacagagtaaatctcaagtctcggtagcagtatcgttcctgatttgtgtgtgtttattataatacttagtagatgcatttatttagtagattcatttagagatgcatttagtagatgcatttagatatccttggtaaatacctttagatatccttagcaaatacctttagtagctacatttaataaatacttgatccatgtttcctaatatttagcaatgtttaataattaataatacttgataaatgtctagtactgtaaaaatgttaaagtaatcatcaatttttttcaacaagagattagtctttttgtttgatacacatacacatacaccatgctaagatgcatggtctaattctactcttgacttttgtaacgtgcatctttctaattctaaacaagaacaattggattcaacaagagttggaacttcacagaaccttggcgtgtatgccttttctgaatcgtgactttatcctctacacgtatcatacgtttgcaccgttgtgtgagccagagccggaaacttcaacataacatgacatccctccagcaaagtgtagctcaagcaacccacgaaacgtaccacggagacgatgacatgaccgatgccaatactagtggaatcgtcaacaatgccaacaatcgaaacagaccacgcagactcagacgacgacgagtcagactggtcaatgccaaagcctatgcggcctacgttaagcacgccaaacgtttgccgtacattaacaagctaatgaaacaggtggccatgatgcatctggaacagtacgacaacgacgacgatagagcactggcctttgtgcgtcaaatgtacttgcgcaaagtcaaatggtccacgttcaagctctactttaggaaactgaaaccactcttttggcccgagaccaaagtgtttgtatcaccgatggtctttgatttgaacaacccacctcagaaccgtgacccggacacggaaaacattcaagtgttggtcaaggcactcaaagagctagtctccaccgatcgctatacgcaccccatactactagcctactatacagggttgcggtcggtggaggtgaatcgcatcaaagtcagccatctgtggcagttgttgcgcaaagacagaacgataccgctgaagcgcaaaaacggcaccgaatggcgagtctactactttaatcaatttgaagagtttctaggtaaactgtccgagttttacagtagggaactggaggcgtttgagcgctacggtatcgatgatgttttgttcaatcagtccacgtctacggtgagctaccatctgaaacgctactacatgaccgtgtgcaagtgcagaccgtatccgggttttggactgcacgtgtttcgatacaatctggccaccgttgtggagaatcgagaggttgcacgaatgattctcgaccacaaggatccccagacaacggaccggtactacatcaaagtcaaccatcccaagacgcagcagagaatcaacacgctaacggtgaccgatccggtgtatgctgcatgtgccaaagtctagagcgagagcttatggtacacaacattagcaaacaagtgtagtacaatagtgtacaaattgaaggttttcttagtttacgaccatgacgaattactacacgctgtgataaatcatgcatgatttttctagattatatgtgcctgtgtgtataatattcatacaatgtaaaagccagaaacaataaccctagtgttccactgactgaatagtagcactatacccactgcgttgaacctgagttttaagagtaaactaggtgtgtaaagtttatagctcaccgtacacctctaccttatcgcacacacatgtatgtgcacatgaatcggtcatctactatttaaggaggccgagatttgctttacaatcagacggccacagttggtgttttaccgttggtgggtacttcatttgtagtgtataataataattgctaggtatttatattcttgtattcttatattctgatattcttatattctggtattcttatattctgatattcttatattcgtattcttgagtatatgtatttgtgcattattcctgagtgaattgttttagtgtagagttgatgtttaattttcaatggttaatttgtaaaggtttaatttgtaaaggtttagtattcaatggttaatatctagtgtttaatattcctagttggtagtgttgtagttttttaatcaactttttactttacttaactatatatatttatttaataatattttaaataatattaaataatatttttaaataatattataaagtagtataaatagtataccaatagtgtttaaaaaacaagatacatcctcctaatacaagcaccctttgtgttacagtttaccatctgctagaaacacgtctaccaacaatcagtaacaaccatcagtatcaatcatcagtactatcaactaccagcaatatcaaccatcaacaacatcaactaccaacagcaactatagcaacatggcaaacctgttgctggtatgcagtctgtttgtcgtccttgtcaaatgttgcacttgttgtgagtataaaactgacgccggttgtctcgtcggacaagatgatcaggtaaccaatactgtcaattttctagggataccctatggtgtcggtcgtaggttcaacaatgccaaactgtacagggcctcaccaaacgacactatgcacgcagacactgacattgagtgcatccagggcgactctctgggcaccgaacactgtctcacactcaacgtgtacaagccccagggtacggtcgccgccagtaggtttcgagtcgtggtcgtggtgcacggtcgagactattacaagagcgatgcacactctgaacgacaccggtactcgcactttaccgatgccgactttatcgttgtccatgtaaactatcgattgtcagtgtttggctttctgtgcattgaccgagatttggcacctagcaatgtgggcgtgcacgatgtgcgtctggccgtacagtgggtcaagaggaacattgccgcattcaacggtgactcggaatcgataaacctactgggctacggatacggtgcagtcattgtgcacattcttgcctggaagggtctggtggtgcgcacagtcacaatgtttgactcgccgctcttgtacaacaccgactcttcgctgccctacaaaacagactcggtgtcggccataaacgaacaggccgtgtgtaccgattcggtcattaggagtgcccgtgtcttggagtttgccaaacgcttaaacttgaccaattcaaccgtggccagtaaacgcatcgagcgtcggttgctgctcaagttgaaacgtctcgacgccagagtactggtgcgtaccgtgcaccgagccgagacggcaactctgaatctgcacggtcaaacctccgatgccagtgtactggtccagttggacgcgtccggtgtgcagggtaacctcagccgaaacttgcccttttccgtgtgcattctcaatgctcgagatgcgttggattttgactttttcaatgtaccctttccggccaccactgtgccggtgctgattgccttcaacggcaacgatagtcgattcgacacactggacggctactggagcaatctgtacaattggcgtttggacagcaagcgtagcattctcaattatacgcattcagaggtggtggtaccattgttgatacactatctaaacacttggaacaacaacaaagccagtactgtaaagcatcagcaagagcttatcgtatcaaacactgaaacgtttctgttcaagcgttccgagaatcaacaatgtcccgatagctctcttgaccccgaatgtaaacattttcattattataacaacagtcgctttacactggaacgagttcctgttgcgacaaatgaaacagtaccctttgtttcaataatgaccactgttggcggttttaatgtgtccatttccgagtactttatcgatgctaaatcggtcggcgttggaagtattattaatggctacgctctaccaaatgttgaatcgggaacgctaaaatttaaatttaaccctctgactctgttacaatctgacgagccaagtgttgatgtagcatcagtgcaaagaggtgcaccacattttgaacctctaccagagctgttgttgtctagtgtaccagaggtggctactactttacatgatggttttactactactatacgtgatacttttacaaccactgctacattacctacactatccaacaatccaactagaccctctactacacacaattcaactcttccctctactacacacaaaccaactctacctacgagtatatttttaaaacccatcagaaaacctaataacggtaccactagcctcattccaatattcccattaaaacctaccataaagaatcaaacggcagtgcactctccgaatccggtcgaacagtacattatagatcagcaagagcaaacgctgagtagccttacaataataatgattatgatcctatgcaccttttctgcactcttgtttgttttagtgtgcaagtttgtagtggccctagtttgtatcagtatataacgaggtgctcgtcttttttcacaggcacatcgaaacaagcgtcacctgttgcaccatcatctgtttgccaagccgtgcaccaacaccacgaccaccataatcgacgaccacgacgagcacaaagacgaccctacaactctgcacaaaaacactacatccaccgttgtcagcaagcccaatggagacactgcaaacactactacgatgacggaagaggtcaaacctctggctagaactcgcagacaccacaaacacaagggctgcgatactgccaagtttatctgtataccgcgtctaatgtcgggtaataaaactattatcgtcgaggattagatgagagaaatattatagagagagtgtggtttgaaccctgtctacagtttatcatgtattatgccactaaacttgtttgattgatgcatcagtcttatctttatgtttgccgtgtttttatgtagatgcagagtggatgcattttttaatgtatttagttgaactgtttttaatgtgtatgtgtattctttaacattcatggttattctttaacattcatgtttacatgtgttgtatttgtttgtgtttaaaaaacaagattttatattttgtaaagtttttattaggtacctacttggaattgtaaacttaaatcttacatctaatgtatcttgcatctaaggtattttacatttaggacatcttacatctagaatatcttgcatccagaatatcttacatctaaagtatcttacatctagggcactcgcatgtattcttacatctagtatttacatttagcaactacacacatatgttttagacagttttacaatacacctaaaaatgcacactgcacttgtatttttcctttcctactaacaccagtctctgtgtatatctctctagacttttgtaaactatacactctatggcacccttttattgcagcttgtagtagtagcatagtaacatagtaatataattgcaccaaagcatatattgtacacatacacttttcgtgcattcagtttttgattcgtttggtgtgatttgattgtaggagacgtgatttgattgtaggagttgcactttgattgtaggctttgtgatttgattatacgttttgtgaggattttactacaggccttgattgcagtctatggctctgattgtaggctttgtttatggctcttgatttaaagattggtttgtatagtgtggtctggaggtaggattcaaaatcagaggttgatttttctcaagaggttttgtagtagtgttgtagattgttgtagattgttgtagattgttgtagattgttgtagattgttttgaatgaaaaactttggtacgggtagattccgattctggtttgggttctactagcatggtcagtatgtttgtcgtgcaatacagtggcccctgttttgcactacttaatccaaatgcacctcgttgccccattccgaggcactttcgtcatcgtcatcctcatcggtactggcaccatagtcggtggcctcttcgctactactactgtagtcatcgtcatcatcatccgcattctcaccctcttcggtgctcgtacccaaaccctcgtcatctgtttgatcttgtcgagagtggtgtgcatttgcagcatagccagaagtcaatctggccagtacgcttcccagtatgaagcccatcaggaagccgacaattatttcaatcttgcatcggcacgtcgagtcgttgcactggtagtagaggtctcccatcaagtgttgaatatcatcgactatgctgtgattgctcaaagggtagtctgaaagactaatggttaaatcttccaaatcaaactcggtctctgatgttggctttcgcaagagactcattgttagaggggtttgatggaggagttgtttggagaggtgttgtagtgtatgtaaaatatactagatcagagtagaatggataggatagagcagaatggataggatagagtagaatggataggctagagtagaacagataggatagagtagaacccgttaggatgctccactattgtgaatgttgaactactgtttgaatttgtattgttcttccatctatataataaacgaatgcacgaactttttagttttatttgattctaagcatcccaaaactaccagtacttgaatgcacagagctacaacatttgccaaataccgagtctaaaaaactagaatcactagtcttctaaaaaactagaacccctagcacctaaaagagtaggaggttgaatcagtctaaaaaactagaacaactcggaaatgcaaagcccccaactttcaagtgtctaggaaatgcctctgaatagtagcatgtttgaatgtttagaaatgcgcgcacaccagagtgtattctacaatagtcgtgcttcttataccaccaatagcgtattatccataattgcatactcactttataggtagctgtaaagctttttcctatgcatgactgttttgtgaatcatggtatttttttaaacggacacgttttcaacatccggtggttggagtatataaacttgcaattgcagataagctcatcattctgtgtactgcaaccctcggagcagcactggtctagtaattatcatcaaaggtctagcatcatcctagtagccccaaccatgtgccctccatccctctaccagttggccattctgcgcgtcatcaagagtgccaaactcagttcggccaagtctttggaacaattgcccaaaccggtggtcgaagacatcaaggcggtacaaactctgcccaagggttggaggtatgccactatgatgcacaacttttgcgactctcgagactacatcggcagcgggttcattctggtgccgtccgagtacgatcagcgcgaaatggaccggctggtcgactacgttggctgtccgtgcatcgaatcgggcctggcttcgatccgtagcggcgagtgcatgtttgctgaactgcgcaaggctgaagtgttccattacctgttgcacaaactctaccagattggtatgaatgtgcgcagcaacattcggtgtctgtacacgttcgacgagtgcactcagttggagtacatgtacagcgtgcctcgtaggacctactttgacctgatggatcggtgggagacaccgctcaagtcgagcctggtagactacaaggtgcccgagtatgtaatcttgggaaagttggcgtttcgcttctctggccagttgtacactgaaatgaagcccagacactttgtccggaatcgtttggtcaagcaacccgagctggtgtcgtacttggaaaagtgtcgcaaacgccacataaaggagcaccaagagggcaccatcaagcggattaaagtgcatcactcggtggaggtggagacctactatggtgttggtttaaactttgatgtttagagactgaggttaaagttggagttgacgttggagttgacgttagagttggtggtagttttagttttttagtgttgtatattgtatattttgacttgtaaattacttgtaacttgtactgtatatattagtgtataaattagtgtataagagtgtatatgattgtatatagtagatgtactagacatgtaagatgaaatagacttgtaagagattttgtaaatattaaagagtatgtaaacatacagctagatgtgaccaatgtgatttgtactaaacttgaaataaacaaagtttctatatattcaaatgtcttttattcccaacattaatcaacctactcttggaaatcaaactaggtactcttgtaaatcaacctactcttgtaaatcaaaaagtgtcttggcaatgaagccagaggcaatttacacaatctagaattgtgcttgtaatgcgtgtatcggttacgcagcagcaaagcaatcacgtttccaacacccgagtggaaattgaacggattcaattttacacgagtcaacttctagacctttgattctgtatttttgcttgaaccggcacaggcatttttagtaccaaaactctcgtttacgaccgtatagattgaattttgtgaaactccagattgaatttcatgatgatttatagtcaatatacagactgcggtttaatggcttaaaatttgagatatttcataatccaatttacaacattaaaacctcgaattttgcattgaattttgagatgctcagttttgcattttgcgatattgtactctgaattttgtaatgttgaattctgtattttgtgatggcatacttaaatcagtgttttaaattttgtgatactgtactttaaattttgtgatattctgctttgaattttggaatagtatagtttgaattttggaatagtatagtttgaattttggaatattatactctgaattttggaatactatactctgaatttagaatattgtacacgtgctacgagtctttaaagtgggtgtatagtatcaagtgataataacaagtatcaagtgataataacaagtatcaagtgacaatgtaacaatacaacaatagatacattgatgctaaaaaataaaaatagatgtaacacagattcaatttctttcagttcatttcattccagttcaatacaatagaatacaacacttgctcaaaacagtgttgtttaaatataaccatttgtaaatgattaaaatattttgcaactacctaatctaacagctaacatctaatatggcactctttgtgatgaacctttaggtcatgtgtatatctatacccactctacctctctacatctctctcccattctacacatttagcaacttgtaaatcaaaacccccaacaacttggccggacctcgtatggttagcgtcatcagagtgtagccctttgcctcggctatggctctgtactcttgcagttcgagctgtgtaaacggttgcagaaacactgccacctttaggttgtcgatcatgatcagagcgtcgtcctctttgggcacgctatacttgatgggcttgtcgatgatgcgtctctcggggctgtcaaagaggcacaagtctttagggtagcacaggtaggcataggcaaagccctggttgaccagtctacagaatcgagccatggcaccgaacgttagtcggctgcgataattaatcttgtgcacgttcagagtgcactccatctgtttacgagtgaagcccatccaggagagaacctctttggattcggtcagacgacgggccaggtcagagtgcttggtagtgtggtgcattgcagccaggatctgtagaaatccagtgcgtgtaatgtacagagtgtcggtttcgtcatctttcaagttttggtaggcgtcgtctacgtgttcgaccatcaagtgtcgatcaaagcccagaacctctgccagttcgttggcgttgattgcaccgttctcgactgacactggacgattcaaaagtaccaaatttgacatgacgtataggggatgcacactgcgcttaacaagcaacatgtcttattacagggttgattcattgaaaataaatttgtaattttcaataaagtatacactgggtgtgtatgcaaaagtggcacattttgagctcagtgtgtttacacagagttggtgctctcctacagagggtagggtatgtttgcatgtatagagcctccgactttggtttagctagtttccctaaattgtatgagcctccgactttggtttagctaggttccctaacttgtgtgcaactttggtataaatgaagggtatgactgaagggtatgaatgaatgtagaaatcaatgtataaatgaaatcacaagttggtagttgaactaatatttattttcatagaataacataaaatgatataatagtataataacaaataatgtaaaataatgtaataatataataacacagtttataaaacaccacagtttagagtttacatttaatgtataacatgatcaatatacaatccttaaatctacatttgttcaatatttgttcttacaattatttcttacaactatatacattgcaattatttcttacatctatatacattacaaatctttcttacaactatatacataacaattattccttacaactataaacattaaactacaactcatcctcaacatcagcatcctcatcggcctcgtcaacatcatcatcatcatcctcatccctaccgttaatcttttgcaacgactctatacaacacttgagcagttcaactgcatcattttgtgacaaacacagggcacgctttacagtctcgacagttggcaactttaacgatttacgactattgttgaggatgcacgcctctagggcctctcggtaatctaccaagtgtctgggcagattcatagttagcttttccaacagactacccaccctgatgctgacaccactggttgatttgaattttctaagtatacgttcgcgcctacgctccagtttgcacaagagcacctcgtccgagtcatcaatgtcagcaagcctagcctcgatggctttaaaactcttttaccagctttttcagctgggaccaattgttggatttggccaactcttttaccgcgaccctagtcttggtgacattgatgcgcttttgttttttagacttggactttttgggtgttgaagtggacgcacgctgttccactgtatcatcaaaataactactccagttcttttgagagttgagattagacgagtccatacgctctagaaaacgcttgtacgatacactagactcgatgtttgattttacagtggatgttggttgttctgggtttggggttgactgttctgggattgacggttctggtacaaactgttctggtacagactcgggttctggttcttgttctggctcagtttcaacctcatacatatcctcctgttcagattcattctcacgctcagatgcattctcacgttcagattcattctcacaatcagatgcattctcatgttccgattcatcctcatgttgaggttcgtgttccgactcatcctcatgctcagattcaggatattcacattcacactcggattcgggttcagagccatcttcaacacattccgattctacaaacttggaaccgttacgctctacgcgttcgtcctcggaaccctcatcgtccgattcatattcacgctcagattcactctcggattcacgattagattcatgctccgagtcactctcagattcatcctcaacctcattctcagattcacgttcaggttcacgttcaggttcacgcataagttcatcctcaacctcattctcagattcacactatggttcacgcataggttgatcctcatcctcaacctcattgtcagattcagattcatactcgaccgtatccatctcggtaacatggttctcattttcattactgtcaacaacacttgtagtaacattgtcctcatcaacacgctcactaacaataatacaaacattactaccaacattattaccaacaccatcctccaacctaggcctctttggactaccatctggatacaagggtacaggtttgaacatttcattcgaatcgacacaactgtctacaaaagtggtcaactctgtgtccatgtcaaaatctttggatctacgacgcttgagcggtgatggggttgttgttgtttgaatttgaacatcctcatcatcgctcaactcgatggactgcaaattgtccatagttacatctacaacactgtcgctagaaacgctctgagccttttgcttgtcattgaaattctcaacttcagaatcaaactcactgtcagatagaatctttctggctttatcgacatcgtcagatgggacagaggacgagttggacctttccagttcaaagtcaatggtgaattgagtgattttagtttgaacagttttaggtttactggtagattcattggaaggtttgctagggctagatggtttagagggtttggttgatttggatgttgatggtttagaaccatcacagtcaccctcctcaccctcatcagaaatgtacaactcgtcctcccatgaaatatcggccgtgtcaggagatcccatgtctatgaccggtgaagccggctctatcctaactgtatgttgagactcatcatcatcgtcctccaactcggtaatttcaacagtcggctgttgttcgtcagagtccgactcttctacaccatcatcaacgcgtaccagagaacgttcatcgttttcgttaatctcatgcaaaacctgtttaaccctatcgatacgtacaccgtccacaatcattgtggagacttcgagcagtttggtagagttgcgattcggttcggaacacttcatcgtacgctttaccctaatctcattgtaatttgcgtcgctagtcttggtgaccttccagttggcccccttttcgggaggcagttctatagagtcgtcggaatcgtaataagcatcatcggtgacctctgaaaagtctgaatcgtaaccgtcatagttgaaatacttgtcatagttggtcggggaatcgttggctcgattctcttcattgtttgggtcgagaaggtctgccagttcgggatcaatgtcaatattggcactgttagtattgttagtgttgttggtattgatagcattgttagtatcgttagtatcaggtctctcgtaggttgcaccaaacaactcttccaataatgcaatgtttgcctctacttgttcaggagtgggtttgggtttggatgatgttggagtgtaagtctctacgtttgtaggttcagtactctcagattcaacattctcctctacatttgtcggttcagtaatctctacatttgtatggtcattagtctctacatttgtatggtcaatagtctcggtctctacagttggaacatcagattcgtactcagagtcggaaatgtaagcagtctcaatgtccatgggctcggttaccactggctcggttgccattggctcggtttgctgtggctgtggctcatttacattagatgtcgactcagcatttacattagatgtagactcggatggagtctctactgtaagctccggggactctacattatcgtaacaagaacaacacatgcagcattcagttacgggttcgtcagttgcacaagatgcattagtagagggctcctctacactagttgaattgtttacatttacattagaggatggttcagaattgagagcagatggagcctcgttggaaattgcccgagtggcctcttgttgagatgcacgagcttcaatgtccgagtctgagtcaaacacttctaccatgtcaagagttggcctaacatagaacaagtcctcgtcaatggaaacctctgcggcttggaaagtcttggcttggaatgttttagattgaactaccacatcaggattgttggtatcgcattcggcaaaggcactcaccggctgagcaatggccgcttcggcttcgctaatgggaggtcttggtggtctattgcgcagagagtcaatctctccgtttaggtagtggcttaaaatcatatctaggatttgggcggttgttaatcggttagatgaggatgaggttgaggttgaggttgaggttgaggcagttgaagtgttggattttgatgtaggtttggatgtatgtttagaggttggttttgatgttggttttgatgtagatttagaggttgagttagaggttgagttagatgatggagcaggcttggatgaggatgttgttgttggtgtaggtttggataaagttggtttagaaacaggtgtagtgttagtagtggtagtagtattagtagtcttgtctgatggcttttcagagggtttggatgaagttggttgtttagaaacagaatcgggtttagtaggcttggatgtaggtttggttagtgttgaagtaggcttgggtgtaggtttggttagtgttgaagtaggcttggatgtaggcttggatgaagttggttgtttagaaacagactcgggtttagaagcaggtttggatgtaggtttggatgaagtaggtttggatggtgttggttgtttagaaacagaatcgggcttagaagcaggcttgggtgtaggagttgaagcaggcttgggtgtaggatttgaagttgaaccaggcttgggtgtaggatttgaagttgaaacaggtttgggtgtaggatttgaagttgaagcaggctttggtgtaggcttggatacatgcttagatgcagttttagaagcagagttggcctcggcaggcttggctgtaggagtaacctttgctacaggcttggaagcagcagatttagacttggaactagacgagtggtgtttagaggaatgcttagagttggaggaatgcttacagttggaggactgcgtagagcttgaatgtttagagtcagacttggatgaatgcttactggaagaggagctcttagagctagaatgtttgggtagcttagaagagctcttggatttggttttaaaactggcactgtacttggagttggatttaaacttggaacttttagagccaaacggttgcggtatgggaccagatgaaacgagttcaatgtcagagtcagagtcgtagtcggattcagagtcgctgctgctgctactactgctgctactactcattataaccctagccctagaccgagcggatgaaatggacattacctcatcgtcgctgtcctcttcgtcctcgccaacccttatgtctctaccgcaatcgtacttgtagtcgctaggtgtatagccgctgttgctatttttaccagaagtgtttttaccagaaccattgttggaactagaacggttggaaccaaaactgttgcttaccttggagcttgcatcagaactcgcatcagaactagagcttacaccagtattaacactagagtttacattatcaacagctttgctagaactgacaccactagtactagcattcgcatccttagagcaatcactagaaccaccgacaccacctcctgaaccagtgccagcattggcagcaatgttggtacaagtgtttacaaaatacgaactaaccaccgacggcggcggctgctgcatctggggctgaacaaacggatgcaaaatggactcggcactctttgctggttgcttggtggtagactgaatgtcggcctgcatctcgttccacaagagcatcatattggcactgctaatgttggcaaagttcagaaaggtcgagtcggtagagatcttttcacgcagattcctagcacatacatactctctgctcaaacgccaattgttgtgatcgtcatcgttaatgttcatatcgaaaaaggtctcgttaaaggactgaatgattctaatgggagcgtacccgtccccgagcagagttagacagttcaacaatttgcttttgagcagacactttaaatctacagtaatctcgtactctttgatgaccatggcggattgatcctctcgtaccttttgatgcaagtcaatcaaaaagtttaaacatccaaatattacagacaccgaaaagagttccttcaaaatcaccttctcctgagagtcttcgcagcgcagaccacgaaactcgggaagcatctccttgatgtgctccagcggcttgggttctcggatcacgacacgtttggtaatgtcgcaagtgcgaagtctcttgatgttgcccggagtcacggcaatggcagtgtacttgacgagcacattgcctcgctgacgaccatcgccattgtagcgaaacacgtacgtaccatacaggcacgaccactctttggtcatgtctagtccaagagcaccggtagacatgattgtagaggagagttgaacacttgtgtaaatcactagtatcagagtcaatcacttggtaaagtttgctcactagtgttggagtcaatcactagtatcagagttggcacttgtactagagttgtagcacagacttgtgattttaccgagttggaatttcagaataaaaactccaaaactcggagaataacagtatttatccgcacagagtccgtacactgactgaataaacaggaaaatgtacgtacagcagggtggctaaagctattatgtagccaacacctaccattatcgtatttatatgaagaattttcagtgggcgtacggtaggtatctggaacatattaaaattgctgttaaattaatgttaaattgctgttaaagttcaattaatggcctgttaaatacaattttctatattatatagaacaaaacgactcgactattaaatccctattaattcacccctccaaagttggaatctaggccatataaaagcaaaaaacctatcctgacctatattcagctcctagatcccggctagacggctagattttgcccgaattaatgcaaattatattccagtgtgtacgtaaacctacaattccagaattaaattttggatttgagttttgcttacaaaacacaagtgtttattaattgcattccggttgctggatttgtaattgttcagaagtcttttaggctctgaatacccgataccaaatatatatttaccaaagacttgtcatttatatcaaatatttttaccaaagacttgtactctaaaaaataccaaagactctaccaaagacttgtgtgtgtgttttgtggcgttgtggcgttgtgtggtggtgttctctctctgaacacgcatctctctctgagctcgcacattgtcttgtgctcgagc

SEQ ID NO: 3 - DNA, 5868 bp, Helicoverpa zea nudivirus 2
atgtctaccggtgctcttggactggacatgaccaaagagtggtcgtgcctgtatggtacgtacgtgtttcgctacaatggcgatggtcgtcagcgaggcaatgtgctcgtcaagtacactgccattgccgtgactccgggcaacatcaagagacttcgcacttgcgacattaccaaacgtgtcgtgatccgagaacccaagccgctggagcacatcaaggagatgctgcccgagtttcgtggtctgcgctgcgaagactctcaggagaaggtgattttgaaggaactcttttcggtgtctgtaatatttggatgtttaaactttttgattgacttgcatcaaaaggtacgagaggatcaatccaccatggtcatcaaagagtacgagattactgtagatttaaagtgtctgctcaaaagcaaattgttgaactgtctaactctgctcggggacgggtacgctcccattagaatcattcagtcctttaacgagacctttttcgatatgaacattaacgatgacgatcacaacaattggcgtttgagcagagagtatgtatgcgctaggaacctgcgtgaaaagatctctaccgactcgacctttctgaactttgccaacattagcagtgccaatatgatgctcttgtggaacgagatgcaggccgacattcagtctaccaccaagcagccagcaaagagtgccgagtccattttgcatccgtttgttcagccccagatgcagcagccgccgccgtcggtggttagttcgtattttgtaaacacttgtaccaacattgctgccaatgctggcactggttcaggagggagtgtcggtggttctagtgattgctctaaggatgctaatgctagtactagtggtgtcagttctagcaaagctgttgataatgtaaactctagtgttgacaactctagtgttaatactggtgtaagctctagttctgatgcgagttctgatgcaagttccaaggtaagcaacagttctggttccaaccgttctggttccaacaatggttctggtaaaaacacttctggtaaaaatagcaacagcggctatacacctagcgactacaagtacgattgcggtagagacataagggttggcgaggacgaagaggacagcgacgatgaggtaatgtccatttcatccgctcggtctagggctagggttataatgagtagtagcagcagtagtagtagcagcgactctgaatccgactacgactctgactctgacattgaactcgtttcatctggtcccataccgcaaccgtttggctctaaaagttccaagtttaaatccaactccaagtacagtgccagttttaaaaccaaatccaagagctcttctaagctacccaaacattctagctctaagagctcctcttccagtaagcattcatccaagtctgactctaaacattcaagctctaagctttcaagcaactccacgcatgcctccaactctaagcattcctccaactctaagcattcctctaaacatcactcgtctagttccaagtctaaatctgctgcttccaagcctgtagcaaaggttactcctacagccaagcctgccgaggccaactctgcttctaaaactgcatctaagcctgtatccaaacctacaccaaagcctgtttccaaacctacaccaaagcctgcttcaacttcaaatcctacacccaaacctgcttctaatcctacacccaagcctgcttctaatcctacatccaaacctgcttctaagcccgagtctgtttctaaacaaccaacaccatccaaacctacttcatccaaacctgcaccaaaacctgcttctaagcccgagtctgtttcaaaacaaccaacttcatccaagcctacatccaagcctacttcaacactaaccaaacctacatccaagcctacttcaacactaaccaaacctacacccaagcctactaaacccgattctgtttctaaacaaccaacatcatccaagccctctgaaaagccatcagacaagactactaatactactaccactactaacactactaacactacacctgtttctaaaccaactttatccaaacctacaccaccaacaacatcatcatccaagcctactccatcatctaactcaacctctaactcaacctctaactcaacctctaactcaacctctaaatctacatcaaaaccaacctctaatacatctaaatctacatctaaacctacatctaaacctacatccaaacctacatcaaaatccaacacttcaactgcctcaacctcaacctcaacctcaacctcatcctcatcctcatctaaccgattaacacccgcccaaatcctagatatgattttaagccactatctaaacggagacattgactctctgcgcaataggccaccaagacctcccattagcgaagccgaagcggccattgctcagccggtgagtgcctttgccgaatgcgataccaataatcctgatgtggtagttcaatctaaaacattccaagccaagactttccaagccgcagaggtttccattgacgaggacttgttctatgttaggccaactcttgacatggtagaagtgtttgactcagactcggacattgaagctcgtgcatctcaacaagaggccactttggcagtttccaatgaggctccatctgctctcaattctgaaccatcctctaatgtaaatgtaaacaattcaactagtgtagaggagccctctactaatgcctcttgtgcaactgacgaacccgtaactgaatgctgcatgtgttgttcttgttacgataatgtagaggactcggagcttacagtagagactccatccgagtctacatctaatgtaaatgctgagtcggcatctaatgtaaatgagccacagccacagcaaactgagccagtggcaaccgagccagtggcaaccgagcccatggacattgagactgcttacatttccgactctgagtacgaatctgatgttccaactgtagagaccgagactaatgactatacaaatgtagagattactgaaccgacaaatgtagagattgatgaaccgacaaatgtagaggagaatgttgaacctgagagtactgaacctacaaacgtagagacttgcactccaacatcatccaaacccaaacccactcctgaacaagtagaggcaaacattgcattattggaagagttgtttggtgcaacctacgagagacctgatactaacgatgctaacaataccaacaataccaacaacactaacaatactaacagtgccaatattgacattgatcccgaactggcagaccttctcgacccaaacaatgaagagaatcgagccaacgattccccgaccaactatgacaagtatttcaactatgacggttacgattcagacttttcagaggtcaccgatgatgcttattacgattccgacgactctatagaactgcctcccgaaaagggggccaactggaaggtcaccaagactagcgacgcaaattacaatgagattagggtaaagcgtacgatgaagtgttccgaaccgaatcgcaactctaccaaactgctcgaagtctccacaatgattgtggacggtgtacgtatcgatagggttaaacaggttttgcatgagattaacgaaaacgatgaacgttctctggtacgcgttgatgatggtgtagaagagtcggactctgacgaacaacagccgactgttgaaattaccgagttggaggatgaggatgatgattctcaacatacagttaggatagagccggcttcaccggtcatagacatggcatctcctgacacggccgatatttcatgggaggacgagttgtacatttctgacgagggagaggagggtgactgtgatggttctaaaccatcaacatccaaaccctctaaaccatctagccctagcaagctttccaatgaatctaccagtaaacctaaaactgttcaaactaaaatcactcaattcaccattgactttgaactggaaaagtccaactcgtcctctgtcccatctgacgatgtcgataaagccagaaagattctatctgacagtgagtttgattctgaagttgaacatttcaatgacaagcaaaaggctcagagcgtttctagcgacagtgttgtagatgtaacaatggacaatttgcagtccatcgagttgagcgatgatgaggatgttcaaattcaaacaacaacaaccccatcaccgctcaagcgtcgtagatccaaagattttgacatggacacagagttgaccacttttgtagacagttgtgtcgattcgaatgaaatgttcaagcctgtgcccttgtatccagatggtagtccaaagaggcctagattggatgatggtgttggtaataatgttggtagtaatattgatagtaatgttagtgagcgtgttgatgaggaaaatgttactacaagtgttgttgagagtaatgaaaatgagaagcatgttagcgagatggatacggtcgagtatgaatctgaatctgagaatgaggatgaggatgaggatgaggatgaggatgaacctatgcgtgaaacagagtgtgaaccagagtgtgaatctgagaatgaggctgaggatgaacttatgcgtgaacctgaacgtgaacctgaacgtgaatctgagaatgaggctgaggatgaatctgagagtgcctctgaacatgaatctaatcgtgaatctgagagtgaatctgagcgtgaatatgaatcggatgatgagggttccgaggacgaacgcgtagagcgtaacggttccaagtttgtagaatcggaatgtgttgaagatggctctgaacccgaatccgagtgtgaatgtgaatatcctgaatctgagcatgaggatgaatctcaacatgaggatgaggatgaatctcaacatgaggatgaatcggaacacgaatctcaacatgagaatacatctgattgtgagaatgaacctgaacatgagaatgcatctgatggtgagaatgaatcggaacatgagaatgcatctgagcgtgagaatgagaatgaatctgaacacgaggatatgtacgaggctgaaactgagccagaacaagaaccagaacccgagtcggtaccagaacagtttgtaccagaacagtcaatcccagaacagtctaccccaaacctagaacaaccaacatccactgtaaaatcaaacatcgagtctagtgtatcgtacaagcgttttctagagcgtatggactcgtctaatctcaactctcaaaagaactggagtagttattttgatgatacagtggaacagcgtgcgtccacttcaacacccaaaaagtccaagtctaaaaaacaaaagcgcatcaatgtcaccaagactagggtcgcggtaaaagagttggccaaatccaacaattggtccaagttgaaaaagctggtaaaagagtttaaagccatcgaggctaggcttgctgacattgatgactcggacgaggtgctcttgtgcaaactggagcgtaggcgcgaacgtatacttagaaaattcaaatcaaccagcggtgtcagcatcagggtgggtagtctgttggaaaagctaactatgaatctacccagacacttggtcgattaccgagaggccctagaggcgtgcatcctcaacaatagtcgtaaatcgttaaagttgccaactgtcgagactgtaaagcgtgccctgtgtttgtcacaaaacgatgcagttgaactgctcaagtgttgtatagagtcgttgcaaaagattaacggtagggatgaggatgatgatgatgatgttgacgaggccgatgaggatgctgatgttgaggatgagttgtag

SEQ ID NO: 4 - DNA, 2925 bp, Helicoverpa zea nudivirus 2
atgtattcttcccattctattctattcaactctactctttatactaacaaacttgcatttgctttaaacttactaacattcacactactcgatctgatattgactaaactaatgaatatctcttgtatgtttatagatggtgacgactcgggaaaggacaaagctggggacacggacaaggctggggacacgggtaaatctgtagagggaaagaataaaactctagagattatgaatcaaactatagagaccaagaataaaactgtagagggaaagaataaaactgtagagggaaagaacaaaactgtagagggtgagagcaaatccaaacctgccgaggataaaaccaaaccggcagaggataaagacaaggggaaagacaaggggacagacaagggcaaaggcaagggtaaaacgactgaggacgaggttgaatctgacgaggatattgacacagacgttgacactgactctgatgaagacgaatatactgaccatgatgaacgaaacaattcagctaaagcatttttgggcgcgtttgctgaatatgatgaggaggcggccaaatcggctgaggagaagcgcaaaaaggcaaaagagttggaacttgctgatgtacccaaagtgaaggatggtgagggttctaaagcaaaggatgaagctaaagcaaaggatgaatccaaggcaaaggcaactcctaaatcaacagagaagcctaaagcaaaggatgaatctaaagcaaaggcaactcctaaatcaacagagaagcctaaagcaaaggacgctcctaaatcaacagagaagcctaaagcaaaggacgctcctaaatcaacagcggaacctaaagcaaaggcaactcctaaatcaacagatgaagctaaagcaaaggaaactcctaaaccaaaggatggttctattcccagctcacttgtaccagattttgaaagtgagccagattacgaatcggatgaagacgagtcttccgagcacgaaataacttctacaacactattgaatgcgttcaacaaattggacgaagagagtcgtaaggaggctgctggtagcactggtactggtagcactggtactggtagctctggctccggtactggctctagtactggtggtggtggcaaatttgccaaacctacacccgattctagcacaccaggtaaagacaaacgagaggttgttagaatagacacggttggtgatgctggctctaaatctggtactaaacatgctgttgttaaatctgggattggtagctctggtaaaggctccgatactggctcgggcacacctaaagttgcagtagccgactctagtgttgaggatgaaatgtcagagggcgaagaggagactgatgaatttgatgaaacgagtgcggctgaggcagaaaaggctcggaaggttttacttgaacttgaaaaaggttctgttgctggaggcaaagctaaatctagtgatgtaggtggtgctaaagtagatgacaaaggaaaggaatcaaagagtcttggtaaaacagaggacaagggtgttaaagtagatgacaagggttctaaagcagagggcaagggtactaaagcagaggacaagggtgttaaagttgacaataaagaggaacctaaagtagatgataaaatagatgacgaatcagacgactctggtatggacattgatgaatctgatgaaacatctgaagaagaggcagaaaggaatcgtaaattgttaatgtctacatttgaaagtttggacaaggaaaagcctgaaaaagtcaaagttgacgacaaggcaaagactgatgaaaaagcaaaggccgatgccgcagcaaaagctaaagctgaggagaaggctaaagccgatgccgctgcaaaagccaaagctgatgaaaaagcaaaggctgaggcgaaggctaaagccgatgctgctgcaaaagccaaagctgatgaaaaagcaaaggctgaggcgaaggctaaagccgatgctgctgcaaaagccaaagctgagaaggctaaagccgatgaaaaagcaaaggccgatgctgctgcaaaagcaaaagccaaagctgaggagaaggcaaaggctgatgcggagaaggctaaagccgatgccgctgcaaaagccaaagctgaggagaaggcaaaggctgacaaggctaaagaatcaaaagaactagagtcaaaggataaaactgaaacacatgaagatgtaccagatgagttggacgagtcgggttatcatgaagatgaagagccaaccggtgtcgattacgaaaagagcaagcgtgcattcctaggtgattttgatagtggtagcagtggtagtggtagtggtagtggtgttggtactggtgttggtactggcacaggtacgggtaagagtactggtggtgctaaggatgaggttgatgctaaagagaaaactgaatccaagccagaaaccaaaccagaatccaaaactgaatctaaagcagaatccaaacctgaatctaaagcagaatccaaaccagaatccaaaacagacagcctagatgaactaatgcccgagtccgtcgatgcatcgctagatatcgaagagatcgatgcctccagtcacacagttgatcgtagctttgtcgatgcactagacggtatggatcatgaaaaagccaagacggcgctaccgtcaatgagtaaggttgatgatggtaaagtaaagaaacgcaagcggtcaaaggagattgatgatgttgtagatgcaaagaagacaaaggaagctagtggtaaactaatagttgatggtacactaaaagatgatgttgaaccaaaaactgatgttgaaccaaaagatgaggttaaatcaaaagaggacccaaaggacaaagctgaaccaaaggacgctgctaaagaaaaggagggtactaaaccaggtactcgtgcttaa

SEQ ID NO: 5 - DNA, 1941 bp, Helicoverpa zea nudivirus 2
atgcccaaagttgaatcgaaagtagtggtagaaactcctaaaattgtagaaccacctaaagcggaatctaaaacagtggaccctcctaaagctgaatctaaaacagtggaccctcctaaagcggaatctaaaacagtggatcctcccaaagcggaatctaaagtagtggtagaaacacctaaaacggtagaaccacctaaagcggaatctaaaacagtggaccctcctaaagttgaagttaaagtagtggatcctcctaaagttgaagttaaagtagtggatcctcctaaaactatagaaccaaccaagactgtagaaatgcccacaattgtagaaacacccacaattgtagaaacacccaatccttcaactcctcctgatttcgatgaaccatctatggaatcgttcgacgaaccgatggatgttgacgaggacgaaatagctccggcattcaatccattcaatgtagttgacaaagagcgcgaagaggttaaacgcaaagaggacgaagccaaacgtaaaaaggccgagtctgaagttgagatgcacaaagatcatgaaatgcactctagtgagtttgaacctccatccattgacgagtccgaggagaccgagactgacgagtacaaggctagtgcggctgcatttaagaatatgttcagcagcatggatgccggtgaaatgccagaatcgattcaacgcaaagatccaaaaattgtagatgttcaaccaaagactcaaccaactttaccaaaggttatagatgtacctcccaagactgtcgaacaacccaaacgtaaaaaagagccaaaacgcaaagaggaacctcccaagactaccgaacaacccaaacgtaaaaaagagcaaaaacgcaaagaggaacctccggtaattccaaaaactatcgaacaacccaaacgtaaagaggacccaataaaagaaacaccaaaggtggacgatggtgaagccaaacgtaaagccgatgctgaagcagcaaagcgcaaggcagatgcggacgccgccaaacgtaaagccgatgctgaagcagcaaagcgaaaggctgatgctgaagcagccgaagccaaacgtaaagccgaggctgaagctgctgccaaacgcaaagcggaggctgaagcagccgaacgaaaaagaattgcagatgaaatagcagccgaagccaaacgtaaagccgatgcggacgccgctaaacgtaaagccgaggcagaagcagcaaaacgcaaggctgatgctgaagctgctgccaaacgtaaagccgaggctgaagcggcagccaaactcaaagccgatgcggaagcagccgccaaacgaaaagcggaggctgaagcagccgaagccaaacgaaaagcggaggctgaggcagccgccaaacgtaaagctgagattgaagcagccgccaaacgtaaagcggaggctgaagctgctgaacgaaaaagaattgcagatgaactagccgccgctaaacgtaaagctgaggctgaggcagccaaacgaaaagcggaggctgaagctgctgaacgaaaaagaattgcagatgaactagccgccgctaaacgtaaagccgaggctgaagcagccgctaaacgcaaagcggaggctgaggctgccgctaaacgcaaagcggaggctgaggctgccgctaaacgcaaagcggaggctgaggctgccgctaaacgtaaagccgaggctgaagctgccgctaaacgtaaagccgaggctgaagctgccgcgaaacgcaaagccgaggctgaagcagccgaacgaaaacgtatagaagatgaaaaacgtattgcagaggaaaaacgtattgcagaggaaaagcgtattagagatgaactagccgccgaagccaaacgtaaagccgacgaggaagcgaaacgtaaaatcgaatcaggtgaatttaaactccacagtcgaatctaa

SEQ ID NO: 6 - DNA, 2966 bp, Helicoverpa zea nudivirus 2
cagtctgattcgagtcgtgttcataccgcactggtgtaggcagcgtctggtactaggtgagtggctcattcttatttaattcatttaatttgtctgctctgtttattcaattttaaaatgtgcagtctcgggtcatctgatacactttttatagctcttagcatacttaaattttatggagcggagtaatcgacccgaatcggacctcggtctggtacgaaacgatagcactgctctttgccaaaaccaaacacaactcgcatctgatccgctctgtgttcgagacatgtcgtccgaatgtgttccttaaaggcgacatgcgaccttgttggtcacaagccactgctcctatgcaaacgggttcctttggttcgattgtgtcgcacgagtggatgctaaattcgcgtgcaggtgtcgagacttagactttttagggagtaggtagcatagatgactcgggctgtcgcttaacgttgaatacgcagggtggactctttgaatggattttattcagatgccacctcgactcgaatcatactggtacccgttttggcactgtagtatcggcaacggtaatgcagtgtcgagacttaaactcttggtggcacagtgtataaactgtaggttctctctctcgtttatgaataatgttattattctacattagtcttatctggcccggcatgtactaggtaggatgtttttattatatacacacatgtgcatttgaggataataacaatggtaatgtgtgcgtgtcgggcatctataaatacacgtgtgcgtgtgtgctgttttattattattaggtaggcgtagcttgcacatgtgccaccatagggacttttagttttgttagtgtagtgtttttgagtgcaagatgtttgtttttactgtgcatttacaagagacttgatggaacacttatatgtagaacagtactactactagaggatagcatttagtagaggtgctgggaacaatagtgtgccgagtataatcataggtatgtgttgcaatacttttttctttatgcttttacattttacgattcattacttgacactgattgatattttatacttgttgatattgtgtggataatttatgaccatctgtgggaatctaggtaggtagggttttatacatgcttacacatacacactgacactgacacacattttacaaacaaacaaaacaaaacaaaagtacattaaaacaaacggaaaaccaataccatacattctatcattctatccttctactactattactactaccactatctactatgggtacctaccaaacattttttaaaaacatttttaaatctatacatacacacatggatttgtgctcacaacaacaaaacacaatcggttagggtcgttgggtctgttgcagtctcggcagcttaggtcggttagttttaggctcggttagtctgtaagcggtacggctagtttataaggttcggttagatataaggttcggttagatataaggctcggttagctataagtcggtgcggctagtttatataagtccggttagatttaagtacggctagtgtataagtcggtgtgagcacaaatcaatagatgtagtaagatgtgatgctttatgaattgaattttatgaattgatacacggacggtaaacaagagttgatttgtgtagtatacgtcttcttcttcctacttcctactattgtaaacaatataaaactaccaaatataaaaccaaacatttgtataaaataacaacacgggttgtacacatttacacatacacactatacacaccaatttagggttatgataatttaggacatttaggataatgacaaagtgtctctggtaaagactggtggtaagactggcaaatactggtatataaatgcaaggatacaactactgtaggtaggtactctgcaactattatactctggtatactcggcaaactttgtgtactctagtactctgataaagctatactctggtaaatattctggtagaactctgtactctgatatactctggtagacttttgtacatatacaactacaacaacaaatctggtaactcggtgactctgactctggcgtctcttggtaactctggtggtattggtattggttgataaaggtatcaacggtttcaaacaaaggtattggtatcaaataacggcatcaaaggtattacacaaaggtattaaacaaaggtattaaacaaaaggtacaaacaataggtttaggcaaatgcacacacataagttaagcacacgtagtaaatgcacagtacgtagggtgtctagtgcagaatttgatactatgagcgtttcggttcggtaccgtttaagagggcgtagagtcaaacctttggcatggtttgtatcgcatgcaacaccaaagctagtggtgcatgttatgctctccgtgcctcatatcccaataataaccaacccatccccatacaagagttcactaaccatactctaaatggtatcgtattgaaagagtttgttgtattcaattcttgcacaattcgtgtagattagaatgcagcaaaagtcttgcacacctaggcgtgcgatgcgatcgttaggctctgtgtacgagtatcgcatcgcacaacaacccactgaccaaccccctcgcaccgtcacgttgtctttcaggcagtctctcgtggcgtgtgcgcttgtttgctttgcaaagagattgccttagtgccttgttgcaaccatggcgtgcaagtgtttgagttgtggacatatgcgatcgattgcctcgcagtaatcggctacgataacgctgcctggtatctccgatgtacattgtcgttaacacacaaaaaacgtgcacgctcttgccaattaacgttaacgtagagtcagtattttaatattaaaaaggtttttttcttttttttcaccacccaataaactaacaattactggtgac

SEQ ID NO: 7 - DNA, 3020 bp, Helicoverpa zea nudivirus 2
cacgatccgcacccgatgtatcgttgaggctcttgactagatttaagagtttttcaatgtcttgatttttggtagtactagtactagtactagtactaggcttggtaggctttggtttagatttcatcatagcatcatcaaatcgtacaattttaacattgtcagccattggtatagtgttgggactcctcttgcttctgtggttcactcggttcattgtttccaaatcgctcacggtcacatctatgggcggtagtttaaaattgggatcgatgtttttacgccagcccgacactgtccatttgtcgtctatggccggaggtggatccttttcgagaggcggtaaagttttgccgttaccgttcgacatggcggtcagaccggcatttatcagcttgattacggcatcgcccactattatgttggccaatttattataccatttagtgtagcaggtacgagtgtcgggatcgaacgcttcgtagtaaacgtcgcaatagtatttgttaaagtgatacgtgtccgtggacggctcatagtcaaagccggtgtcgagatcgtttagcctaggcgcgtacagttcactggaccgataccggggaatctccatccaggtggctgcaaaaggtacgatattgcaagtgttgctagtctctgaccaacggtagcgaacgttgtgtggcttgtcggtaccgtcatcggtgtgcacggccgtttcgaacaagtggaagcaggccggattgcattgaacctcaaagttttcactctcacccaatctatagtagctggccgcatccgtctttttgcagggtccgtgcacaccggacgagttgcacgaaatgctctcgcacaattgttttgtaatctctgcctctacgaatatggcctcggaggccattgccggtggaatgtaataatcggcatcggtggccgctctgacgttgactttcaagtgcgacgccaagaagggatacttttcgttgagcttgtgcagtagcatcaagagtttacgatggtacgaaaacttggaggcatttgcaatgtctaattgggtgtaggttgtggtggtagtggtagtggtagtagggtttgttggtgttgtaggattaggattagggttaaggttagtaggtacagtagacattgttggttgtgtggattcattaacctagcatatacatacacacaaacgtgatatttatacaaagatttatacctaatatttattaagtactcgataagtacaaagattcaagtacctagtactactatggggaacgtgcacacacagactctctcttccttttgaaggaatttaaactttttgtacaataaaattaacaagcaagattaatatgcaaatagcaataacgtgcaggttaatatgcaaattttaatgaggagttcaacttatgagacttttatgacaatatcaagttttgtaaataaaaggttattttcaactgcaacaatgtgtgatgcaaatttgagtttgtacagagtagctctattaaaaaagaatactgcaagcgttgttcattttatacacaacttgtcatatacgagtactagtaacactactagtaccactactacaactagtacaactagtactacaacccatcatagaggtttaccaattcttgtaatctttcaatcttgtaatataaactaaaactaaatattcttacattaccaattctctttacaataccaattcttacaataccaatcatcattatacaataccaattcttacaataccaattcttacaataccaatcatccttacaattattacaactgccaattatagctctatgtagctctaccaccagctactacagtctacactctacacgctctactacatgatccagtacatgctccactctacacactacggcactcggcacgctccactcgacacactctactctacatactcttatcctaatactcttacaaatatttaaacaacaaataacaagcaatagcaacaacataggcggactttaagactttactgtaaactaggatgttcagactactttgataaactaggactttaaaacaaattgatacattataataaaagtacaacaaaagtacaacaacccactacctcccttcaaacaccaaatcccttggatctttacaagtactttaaatttccaaacattttagatccatgattaaagtacaagtctatgcgatccggtagcaggcttagcgcagtcttgaacgctctcgaatgatcacgttctttgggatttagtcgcaaatagaatgtatagtcgcctatgtagttgctgggcttgtcgtccaccaggcacgagtatgtaatcattgtagttttaaactttcgattcagctgcttgagtacaaaaccgatgcccttgttgaagccgtacgatgtgtggtacgatctcgtaatgacaatgtcaaacagagaatagagccgcaaccgcttcaagtgtccgattacgtgaccggggtctccgtgcgaccacaccaccattcgtttaaagtgcttcttgaactgcaacaggtagtggatgagatcctcggacgttagcgtgccatcgtcgttgatgagcgtctcgtccagatcccacaccaccaccgattcgtgccgttcgatggattgcttaaaggttctgtacagcttgataatgtgagagatgagcgcttcgctagtgggaaactcttcgccgtttacatagtctacgtacaagttttgctggatcaggtagtcgacgttttcaaagtagactagcaccgagtaaccaatggatctggcaccggtctcgtcccatttcccctggcacactttgtcgttgatgaccaaattttgaaatacactggccaggttaaagtgaatcaaacgattccgcttcttgtagttggaatcgactattctacaaaaagacatggcgactgcatctggtatacgttttaacgcgtacaacgagcatattcaatattcgatataggtcataagacgtttaccctattgc

SEQ ID NO: 8 - DNA, 4838 bp, Helicoverpa zea nudivirus 2
taatagctttagccaccctgctgtacgtacattttcctgtttattcagtcagtgtacggactctgtgcggataaatactgttattctccgagttttggagtttttattctgaaattccaactcggtaaaaatcacaagtctgtgctacaactctagtacaagtgctaaactctgatactagtgattggctccaacactagtgaccaaactttaccaagtgattgactctgatactagtgatttacacaagtgttcaactctcctctacaatcatgtctaccggtgctcttggactggacatgaccaaagagtggtcgtgcctgtatggtacgtacgtgtttcgctacaatggcgatggtcgtcagcgaggcaatgtgctcgtcaagtacactgccattgccgtgactccgggcaacatcaagagacttcgcacttgcgacattaccaaacgtgtcgtgatccgagaacccaagccgctggagcacatcaaggagatgctgcccgagtttcgtggtctgcgctgcgaagactctcaggagaaggtgattttgaaggaactcttttcggtgtctgtaatatttggatgtttaaactttttgattgacttgcatcaaaaggtacgagaggatcaatccaccatggtcatcaaagagtacgagattactgtagatttaaagtgtctgctcaaaagcaaattgttgaactgtctaactctgctcggggacgggtacgctcccattagaatcattcagtcctttaacgagacctttttcgatatgaacattaacgatgacgatcacaacaattggcgtttgagcagagagtatgtatgcgctaggaacctgcgtgaaaagatctctaccgactcgacctttctgaactttgccaacattagcagtgccaatatgatgctcttgtggaacgagatgcaggccgacattcagtctaccaccaagcagccagcaaagagtgccgagtccattttgcatccgtttgttcagccccagatgcagcagccgccgccgtcggtggttagttcgtattttgtaaacacttgtaccaacattgctgccaatgctggcactggttcaggagggagtgtcggtggttctagtgattgctctaaggatgctaatgctagtactagtggtgtcagttctagcaaagctgttgataatgtaaactctagtgttgacaactctagtgttaatactggtgtaagctctagttctgatgcgagttctgatgcaagttccaaggtaagcaacagttctggttccaaccgttctggttccaacaatggttctggtaaaaacacttctggtaaaaatagcaacagcggctatacacctagcgactacaagtacgattgcggtagagacataagggttggcgaggacgaagaggacagcgacgatgaggtaatgtccatttcatccgctcggtctagggctagggttataatgagtagtagcagcagtagtagtagcagcgactctgaatccgactacgactctgactctgacattgaactcgtttcatctggtcccataccgcaaccgtttggctctaaaagttccaagtttaaatccaactccaagtacagtgccagttttaaaaccaaatccaagagctcttctaagctacccaaacattctagctctaagagctcctcttccagtaagcattcatccaagtctgactctaaacattcaagctctaagctttcaagcaactccacgcatgcctccaactctaagcattcctccaactctaagcattcctctaaacatcactcgtctagttccaagtctaaatctgctgcttccaagcctgtagcaaaggttactcctacagccaagcctgccgaggccaactctgcttctaaaactgcatctaagcctgtatccaaacctacaccaaagcctgtttccaaacctacaccaaagcctgcttcaacttcaaatcctacacccaaacctgcttctaatcctacacccaagcctgcttctaatcctacatccaaacctgcttctaagcccgagtctgtttctaaacaaccaacaccatccaaacctacttcatccaaacctgcaccaaaacctgcttctaagcccgagtctgtttcaaaacaaccaacttcatccaagcctacatccaagcctacttcaacactaaccaaacctacatccaagcctacttcaacactaaccaaacctacacccaagcctactaaacccgattctgtttctaaacaaccaacatcatccaagccctctgaaaagccatcagacaagactactaatactactaccactactaacactactaacactacacctgtttctaaaccaactttatccaaacctacaccaccaacaacatcatcatccaagcctactccatcatctaactcaacctctaactcaacctctaactcaacctctaactcaacctctaaatctacatcaaaaccaacctctaatacatctaaatctacatctaaacctacatctaaacctacatccaaacctacatcaaaatccaacacttcaactgcctcaacctcaacctcaacctcaacctcatcctcatcctcatctaaccgattaacacccgcccaaatcctagatatgattttaagccactatctaaacggagacattgactctctgcgcaataggccaccaagacctcccattagcgaagccgaagcggccattgctcagccggtgagtgcctttgccgaatgcgataccaataatcctgatgtggtagttcaatctaaaacattccaagccaagactttccaagccgcagaggtttccattgacgaggacttgttctatgttaggccaactcttgacatggtagaagtgtttgactcagactcggacattgaagctcgtgcatctcaacaagaggccactttggcagtttccaatgaggctccatctgctctcaattctgaaccatcctctaatgtaaatgtaaacaattcaactagtgtagaggagccctctactaatgcctcttgtgcaactgacgaacccgtaactgaatgctgcatgtgttgttcttgttacgataatgtagaggactcggagcttacagtagagactccatccgagtctacatctaatgtaaatgctgagtcggcatctaatgtaaatgagccacagccacagcaaactgagccagtggcaaccgagccagtggcaaccgagcccatggacattgagactgcttacatttccgactctgagtacgaatctgatgttccaactgtagagaccgagactaatgactatacaaatgtagagattactgaaccgacaaatgtagagattgatgaaccgacaaatgtagaggagaatgttgaacctgagagtactgaacctacaaacgtagagacttgcactccaacatcatccaaacccaaacccactcctgaacaagtagaggcaaacattgcattattggaagagttgtttggtgcaacctacgagagacctgatactaacgatgctaacaataccaacaataccaacaacactaacaatactaacagtgccaatattgacattgatcccgaactggcagaccttctcgacccaaacaatgaagagaatcgagccaacgattccccgaccaactatgacaagtatttcaactatgacggttacgattcagacttttcagaggtcaccgatgatgcttattacgattccgacgactctatagaactgcctcccgaaaagggggccaactggaaggtcaccaagactagcgacgcaaattacaatgagattagggtaaagcgtacgatgaagtgttccgaaccgaatcgcaactctaccaaactgctcgaagtctccacaatgattgtggacggtgtacgtatcgatagggttaaacaggttttgcatgagattaacgaaaacgatgaacgttctctggtacgcgttgatgatggtgtagaagagtcggactctgacgaacaacagccgactgttgaaattaccgagttggaggatgaggatgatgattctcaacatacagttaggatagagccggcttcaccggtcatagacatggcatctcctgacacggccgatatttcatgggaggacgagttgtacatttctgacgagggagaggagggtgactgtgatggttctaaaccatcaacatccaaaccctctaaaccatctagccctagcaagctttccaatgaatctaccagtaaacctaaaactgttcaaactaaaatcactcaattcaccattgactttgaactggaaaagtccaactcgtcctctgtcccatctgacgatgtcgataaagccagaaagattctatctgacagtgagtttgattctgaagttgaacatttcaatgacaagcaaaaggctcagagcgtttctagcgacagtgttgtagatgtaacaatggacaatttgcagtccatcgagttgagcgatgatgaggatgttcaaattcaaacaacaacaaccccatcaccgctcaagcgtcgtagatccaaagattttgacatggacacagagttgaccacttttgtagacagttgtgtcgattcgaatgaaatgttcaagcctgtgcccttgtatccagatggtagtccaaagaggcctagattggatgatggtgttggtaataatgttggtagtaatattgatagtaatgttagtgagcgtgttgatgaggaaaatgttactacaagtgttgttgagagtaatgaaaatgagaagcatgttagcgagatggatacggtcgagtatgaatctgaatctgagaatgaggatgaggatgaggat

SEQ ID NO: 9 - DNA, 1392 bp, Helicoverpa zea nudivirus 2
atgcacggtaaaaaaggcgccaaagagaactttgatgattctagtgaaattgttagcaaaaaagcaatgaagatgggtatagggtttggcgttgatgatgatggttatgagaatatatcagactcggactctgagtctagtgtagaaacggttgctagtccgcccagtattgaaaaggaggttattgttgaaaaggaggttattgaaaaggatgttgttgaaaaggaggttatcgaaaaggttgttattgaaaaggaaaaggatggtattgaaaaggaggttgttgaagaaaaggatgttattgaaaaagaggttattgaaaaagaggttattgaaaaagaggttattgaaaaggaggttattgaagaaaaggatgttattgaaaagagtagtgtagcatcaagtgttgaaactggtggtactataccaagcactgaaaaggcaacaaatccacccaccattgaaaagacggttccagcaacggtgctagaccctacactagttatggaagtggatgaggatgacgatgactatttagaggcagaaccaatggatgtagatatcgagtccgagcctgaacccaagagtgaatcggttccaaaggatggttctgtagagacaatgaaggatagcactttagagccaaaagaggtaaaggttgtaagtccagttatagattcaaaggaaaagactgtagatgagaaatctgaaatgcatgtagattcaactgtaggtaaatctgtagtggtttcagagccaaaagtagtcgatgtcaaggtagatgctaagggtgatcctaaattagattccaaagttggtaaattggatgataaatcggaggcaaaaactgaacctaaaaccgatgctaaaattaatataaaaacaattgaccctaaagtagatggtagcgttgaaacaaaggcagagcccaaattagacaaagtggatgataaatctaaagatgaggttatgccagaaagtaggccagaacttaaaccagaaagcaagccagaaattataccagagagtaagttagaaactaagccagagagtaggccagaaattataccagagagcaagtcggaagctaaaccagagagtaggccagaaattataccagagagcaagtcggaagctaaaccagagagtaagccagaaattaaatcagagagcaagtcggaagctaaaccagaaagcaagacagaaactataccagagagtaggccagaaattataccagagagcaaggcagaaactaaaattgaccctaaagttgaatccaaagaatccaaacctaaagatgcccctaaagtagagctatccaaagctgaacccaaggtagttgaaaacctaaaactgatcctcctaaagatgatccagaaccaaaagtag

SEQ ID NO: 10 - DNA, 25 bp, Artificial Sequence
  Primer
gtggtgccagactttcagacatcat

SEQ ID NO: 11 - DNA, 25 bp, Artificial Sequence
  Primer
gggtctgttgcgacctaaaggtcta

SEQ ID NO: 12 - DNA, 24 bp, Artificial Sequence
  Primer
cgaagagctcttcactggcgtggt

SEQ ID NO: 13 - DNA, 24 bp, Artificial Sequence
  Primer
ggtgttttgctggtaatgatccgc

SEQ ID NO: 14 - DNA, 24 bp, Helicoverpa zea nudivirus 2
atgaagctgaggatgaatctgaac

SEQ ID NO: 15 - DNA, 36 bp, Helicoverpa zea nudivirus 2
gaaactcctaaatcaaaggatgaacctaaagcaaag

SEQ ID NO: 16 - DNA, 60 bp, Helicoverpa zea nudivirus 2
atgaaaaagcaaaggctgaggcgaaggctaaagccgatgctgctgcaaaagccaaagctg

SEQ ID NO: 17 - DNA, 24 bp, Helicoverpa zea nudivirus 2
ttataccagagagcaagccagaaa

SEQ ID NO: 18 - DNA, 81 bp, Helicoverpa zea nudivirus 2
acctaaagttgaatctaaagtagtggaaccacctaaagcggaatctaaaacagtggaagctcctactaaaacagttgaagt

SEQ ID NO: 19 - DNA, 30 bp, Helicoverpa zea nudivirus 2
agctgccgctaaacgcaaagccgaggctga

What is claimed is:

1. A genetically modified *Helicoverpa zea* nudivirus 2 (HzNV-2) virus, having a mutation in a region selected from Open Reading Frame 90 (ORF90), Open Reading Frame 92 (ORF92), Persistance-associated Gene (pag1), or a combination thereof, to disrupt expression of the gene product encoded by said mutant region, wherein said mutation increases the rate of an agonadal phenotype in a progeny of a *Helicoverpa zea* (*H. zea*) moth infected with said genetically modified HzNV-2 as compared to a progeny of a *H. zea* moth infected with a wild-type HzNV-2 virus.

2. The genetically modified nudivirus of claim 1, wherein said genetically modified HzNV-2 virus is achieved via chemical mutagenesis.

3. The genetically modified nudivirus of claim 1, wherein said genetically modified HzNV-2 virus is achieved via recombinant DNA technology.

4. The genetically modified nudivirus of claim 1, wherein said genetically modified HzNV-2 virus is achieved via gene editing technology.

5. An insect infected with the virus of claim 1.

6. The insect of claim 5, wherein said insect is *H. zea.*

7. A method of protecting a crop susceptible to *H. zea* moth crop damage, comprising the step of introducing an *H. zea* moth infected with the genetically modified nudivirus of claim 1 into said crop.

* * * * *

UNITED STATES PATENT AND TRADEMARK OFFICE

CERTIFICATE OF CORRECTION

PATENT NO. : 9,770,033 B2
APPLICATION NO. : 15/154069
DATED : September 26, 2017
INVENTOR(S) : Bruce Webb et al.

It is certified that error appears in the above-identified patent and that said Letters Patent is hereby corrected as shown below:

In the Claims

Column 25, Claim 1, Line 18, reads "...Persistance-associated Gene (pag1), or a..."; which should be deleted and replaced with "...Persistance-associated Gene *(pag1)*, or a..."

Signed and Sealed this
Thirty-first Day of October, 2017

Joseph Matal
*Performing the Functions and Duties of the*
*Under Secretary of Commerce for Intellectual Property and*
*Director of the United States Patent and Trademark Office*